US008257956B2

(12) United States Patent
Lassner et al.

(10) Patent No.: US 8,257,956 B2
(45) Date of Patent: Sep. 4, 2012

(54) SULFONYLUREA-RESPONSIVE REPRESSOR PROTEINS

(75) Inventors: Michael Lassner, Urbandale, IA (US); Loren L. Looger, Madison, AL (US); Kevin E. McBride, Davis, CA (US); Brian McGonigle, Wilmington, DE (US)

(73) Assignees: E. I. du Pont de Nemours and Company, Wilmington, DE (US); Pioneer Hi-Bred International, Inc., Johnston, IA (US)

( * ) Notice: Subject to any disclaimer, the term of this patent is extended or adjusted under 35 U.S.C. 154(b) by 36 days.

(21) Appl. No.: 12/603,739

(22) Filed: Oct. 22, 2009

(65) Prior Publication Data
US 2010/0105141 A1   Apr. 29, 2010

Related U.S. Application Data

(60) Provisional application No. 61/108,917, filed on Oct. 28, 2008.

(51) Int. Cl.
C12N 1/20 (2006.01)
C07H 21/04 (2006.01)
(52) U.S. Cl. ............... 435/252.3; 536/23.7; 435/252.33; 435/252.8
(58) Field of Classification Search .................. None
See application file for complete search history.

(56) References Cited

U.S. PATENT DOCUMENTS

| | | | |
|---|---|---|---|
| 5,464,758 A | 11/1995 | Gossen et al. | |
| 5,589,362 A | 12/1996 | Bujard et al. | |
| 5,650,298 A | 7/1997 | Bujard et al. | |
| 5,654,168 A | 8/1997 | Bujard et al. | |
| 5,723,765 A | 3/1998 | Oliver et al. | |
| 5,789,156 A | 8/1998 | Bujard et al. | |
| 5,814,618 A | 9/1998 | Bujard et al. | |
| 5,851,796 A | 12/1998 | Schatz | |
| 5,859,310 A | 1/1999 | Bujard et al. | |
| 5,866,755 A | 2/1999 | Bujard et al. | |
| 5,888,981 A | 3/1999 | Bujard et al. | |
| 5,912,411 A | 6/1999 | Bujard et al. | |
| 5,917,122 A * | 6/1999 | Byrne ............................ 800/18 |
| 5,922,927 A | 7/1999 | Bujard et al. | |
| 5,925,808 A | 7/1999 | Oliver et al. | |
| 5,977,441 A | 11/1999 | Oliver et al. | |
| 6,004,941 A | 12/1999 | Bujard et al. | |
| 6,087,166 A | 7/2000 | Baron et al. | |
| 6,136,954 A | 10/2000 | Bujard et al. | |
| 6,242,667 B1 | 6/2001 | Bujard et al. | |
| 6,252,136 B1 | 6/2001 | Bujard et al. | |
| 6,271,341 B1 | 8/2001 | Baron et al. | |
| 6,271,348 B1 | 8/2001 | Bujard et al. | |
| 6,783,756 B2 | 8/2004 | Bujard et al. | |
| 6,914,124 B2 | 7/2005 | Bujard et al. | |
| 2003/0186281 A1 | 10/2003 | Hillen | |
| 2003/0208783 A1 | 11/2003 | Hillen et al. | |
| 2004/0133944 A1 | 7/2004 | Hake et al. | |
| 2004/0148649 A1 | 7/2004 | Lydiate et al. | |
| 2005/0034187 A1 | 2/2005 | Golovko et al. | |
| 2005/0042752 A1 | 2/2005 | Crete et al. | |
| 2005/0216976 A1 | 9/2005 | Meagher et al. | |

FOREIGN PATENT DOCUMENTS

| | | |
|---|---|---|
| CN | 1 385 527 A | 12/2002 |
| EP | 0 494 724 A2 | 7/1992 |
| WO | WO 96/04393 A2 | 2/1996 |
| WO | 96/40892 | 12/1996 |
| WO | 96/40946 | 12/1996 |
| WO | 99/27108 | 6/1999 |
| WO | 00/75347 | 12/2000 |
| WO | WO 02/20811 | 3/2002 |
| WO | 03/029453 | 4/2003 |
| WO | 03/056021 | 7/2003 |
| WO | 2004/020645 | 3/2004 |
| WO | WO 2005/012534 | 2/2005 |
| WO | 2005/123923 | 12/2005 |
| WO | 2006/124502 | 11/2006 |
| WO | 2007/133797 | 11/2007 |
| WO | WO 2008/064056 | 5/2008 |
| WO | WO 2010/062518 A1 | 6/2010 |

OTHER PUBLICATIONS

Patel et al Gene. Mar. 1, 1992;112(1):67-76 (abstract only).*
De Veylder Lieven et al., "Herbicide Safener-Inducible Gene Expression in *Arabidopsis thaliana*," Plant and Cell Physiology, 1997, pp. 568-577, vol. 38(5).
Gatz et al., "Stringent Repression and Homogenous De-repression by Tetracycline of a Modified CaMV 35S Promoter in Intact Transgenic Tobacco Plants," Plant Journal, 1992, pp. 397-404, vol. 2(3), Blackwell Scientific Publications, Oxford, GB.
U.S. Appl. No. 13/086,765, filed Apr. 14, 2011.
Scholz, et al., Activity reversal of Tet repressor caused by single amino acid exchanges, Mol. Microbiology, (2004), 53(3): 777-789.
Wharton, et al., Substituting an a-Helix Switches the Sequence-Specific DNA Interactions of a Repressor, Cell, (1984), 38:361-369.
Dallmann, et al., The isolated N-terminal DNA binding domain of the c repressor of bacteriophage 16-3 is functional in DNA binding in vivo and in vitro, Mol Gen Genet (1991), 227:106-112.
POG Chapter 15, Advanced transgenic technology, (2005), 15:299-320.
Kramer, et al., An engineered epigenetic transgene switch in mammalian cells, Nature Biotechnology, (2004), 22 (7):867-870.
Wharton, et al., Changing the binding specificity of a repressor by redesigning an a-helix, Nature, (1985), 316:601-605.
Hollis, et al., A repressor heterodimer binds to a chimeric operator, Proc. Natl. Acad. Sci. USA (1988), 85:5834-5838.

(Continued)

Primary Examiner — Padma Baskar

(57) ABSTRACT

Compositions and methods relating to the use of sulfonylurea-responsive repressors are provided. Compositions include polypeptides that specifically bind to an operator, wherein the specific binding is regulated by a sulfonylurea compound. Compositions also include polynucleotides encoding the polypeptides as well as constructs, vectors, prokaryotic and eukaryotic cells, and eukaryotic organisms including plants and seeds comprising the polynucleotide, and/or produced by the methods. Also provided are methods to provide a sulfonylurea-responsive repressor to a cell or organism, and to regulate expression of a polynucleotide of interest in a cell or organism, including a plant or plant cell.

2 Claims, 11 Drawing Sheets

OTHER PUBLICATIONS

Degenkolb, et al., Structural Requirements of Tetracycline-Tet Repressor Interaction: Determination of Equilibrium Binding Constants for Tetracycline Analogs with the Tet Repressor, Antimicrobial Agents and Chemotherapy, (1991), 35(8):1591-1595.

Bustos, et al., Functional domains of the AraC protein, Proc. Natl. Acad. Sci. USA (1993), 90:5638-5642.

Lallo, et al., A two-hybrid system based on chimeric operator recognition for studying protein homo/ heterodimerization in *Escherichia coli*, Microbiology, (2001), 147:1651-1656.

Backes, et al., Combinations of the a-Helix-turn-a-Helix Motif of TetR with Respective Residues from Lacl or 434Cro: DNA Recognition, Inducer Binding, and Urea-Dependent Denaturation, Biochemistry (1997), 36:5311-5322.

Wilcken-Bergmann, et al., 72 Residues of gal repressor fused to B-galactosidase repress the gal operon of *E. coli*, EMBO Journal (1983), 2(8):1271-1274.

Zeng, et al., Detection of tetramerization domains in vivo by cooperative DNA binding to tandem n operator sites, Gene (1997), 185:245-249.

Helbl, et al., Stepwise Selection of TetR Variants Recognizing tet Operator 4C with High Affinity and Specificity, J. Mol. Biol., (1998), 276:313-318.

Helbl, et al., Stepwise Selection of TetR Variants Recognizing tet Operator 6C with High Affinity and Specificity, J. Mol. Biol. (1998), 276:319-324.

Muller, et al., Characterization of non-inducible Tet repressor mutants suggests conformational changes necessary for induction, Nature Structural Biology, (1995), 2(8):693-703.

Wang, et al., Transcriptional Repression in *Saccharomyces cerevisiae* by a SIN3-LexA Fusion Protein, Mol. and Cell. Biology, (1993), 13(3):1805-1814.

Isackson, et al., Dominant negative mutations in the Tn10 tet repressor: Evidence for use of the conserved helix-turn-helix motif in DNA binding, Proc. Natl. Acad. Sci. USA, (1985), 82:6226-6230.

Bertram, et al., Phenotypes of Combined Tet Repressor Mutants for Effector and Operator recognition and Allostery, J. Mol. Microbiology and Biotechnol., (2004), 8:104-110.

Urlinger, et al., Exploring the sequence space for tetracycline-dependent transcriptional activators: Novel mutations yield expanded range and sensitivity, PNAS (2000), 97(14):7963-7968.

Berens, et al., Gene regulation by tetracyclines, Eur. J. Biochem., (2003), 270:3109-3121.

Kamionka, et al., Two mutations in the tetracycline repressor change the inducer anhydrotetracycline to a corepressor, Nucleic Acids Research, (2004), 32(2):842-847.

Scholz, et al., Teaching TetR to Recognize a New Inducer, J. Mol. Biol., (2003), 329:217-227.

Ramos, et al., The TetR Family of Transcriptional Repressors, Microbiology and Mol. Biology Rev., (2005), 69 (2):326-356.

Orth, et al., Structural basis of gene regulation by the tetracycline inducible Tet repressor—operator system, Nature Structural Biology, (2000), 7(3):215-219.

* cited by examiner

Figure 9

SULFONYLUREA-RESPONSIVE REPRESSOR PROTEINS

CROSS-REFERENCE TO RELATED APPLICATIONS

This application claims the benefit of U.S. Application Ser. No. 61/108,917 filed Oct. 28, 2008, which is herein incorporated by reference in its entirety.

FIELD OF THE INVENTION

The invention relates to the field of molecular biology, more particularly to the regulation of gene expression.

BACKGROUND

The tetracycline operon system, comprising repressor and operator elements, was originally isolated from bacteria. The operon system is tightly controlled by the presence of tetracycline, and self-regulates the level of expression of tetA and tetR genes. The product of tetA removes tetracycline from the cell. The product of tetR is the repressor protein that binds to the operator elements with a $K_d$ of about 10 pM in the absence of tetracycline, thereby blocking expression or tetA and tetR.

This system has been modified to control expression of other polynucleotides of interest, and/or for use in other organisms, mainly for use in animal systems. Tet operon based systems have had limited use in plants, at least partially due to problems with the inducers which are typically antibiotic compounds, and sensitive to light.

There is a need to regulate expression of sequences of interest in organisms, compositions and methods to tightly regulate expression in response to sulfonylurea compounds are provided.

SUMMARY

Compositions and methods relating to the use of sulfonylurea-responsive repressors are provided. Compositions include polypeptides that specifically bind to an operator, wherein the specific binding is regulated by a sulfonylurea compound. Compositions also include polynucleotides encoding the polypeptides as well as constructs, vectors, prokaryotic and eukaryotic cells and eukaryotic organisms including plants and seeds comprising the polynucleotide and/or produced by the methods. Also provided are methods to provide a sulfonylurea-responsive repressor to a cell or organism and to regulate expression of a polynucleotide of interest in a cell or organism, including a plant or plant cell.

BRIEF DESCRIPTION OF DRAWINGS

FIG. 9. Summary of source diversity, library design, and hit diversity and population bias for several generations of sulfonylurea repressor shuffling libraries. A dash ("-") indicates no amino acid diversity introduced at that position in that library. An X indicates that the library oligos were designed to introduce complete amino acid diversity (any of 20 amino acids) at that position in that library. Residues in bold indicate bias during selection with larger font size indicating a greater degree of bias in the selected population. Residues in parentheses indicate selected mutations. The phylogenetic diversity pool is derived from a broad family of 34 tetracycline repressor sequences.

DETAILED DESCRIPTION

Figure 1:
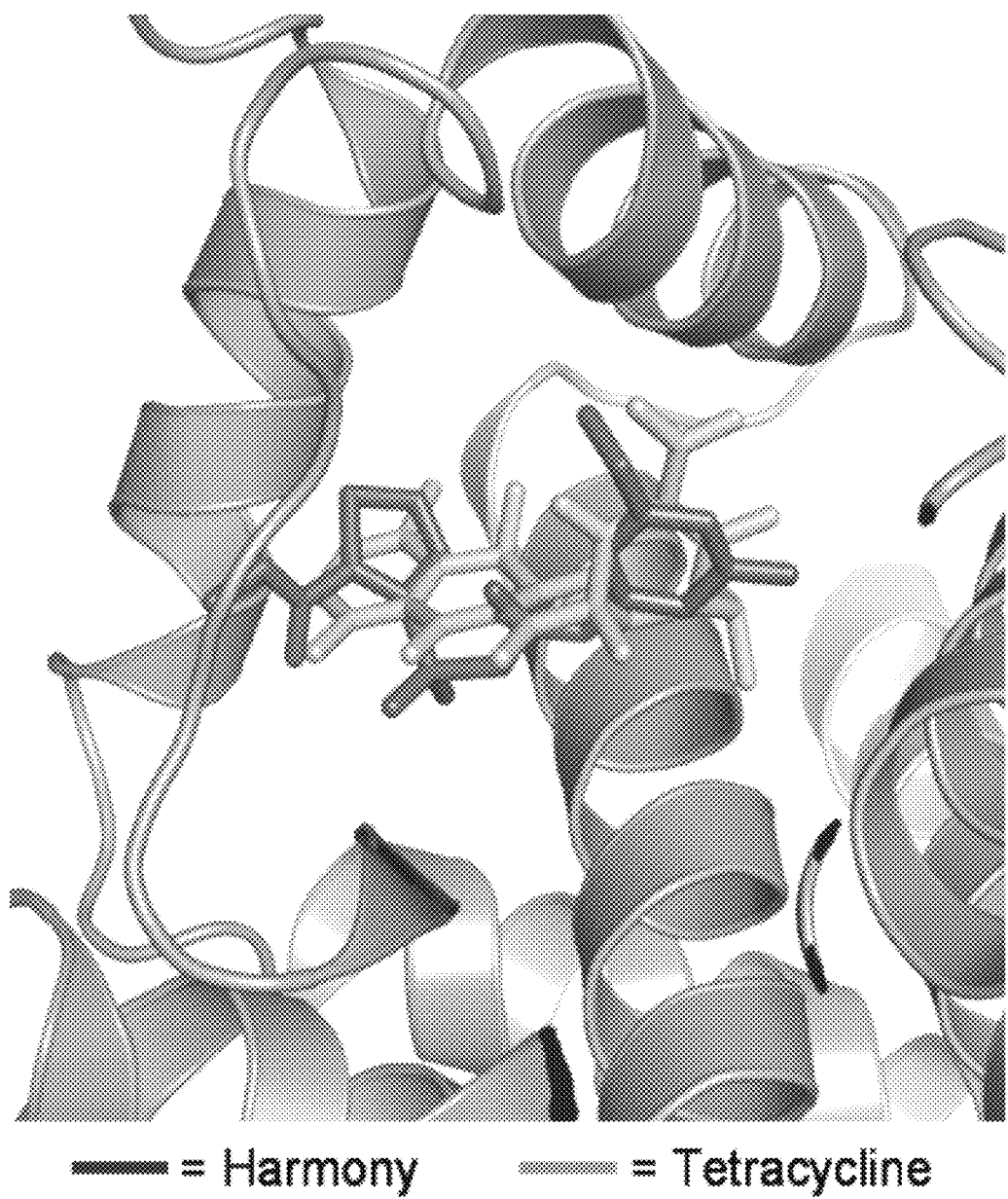
FIG. 1. Docking of tetracycline-Mg++ and the sulfonylurea compound Harmony® (thifensulfuron-methyl; Ts) into the binding pocket of class D TetR based on the crystal structure 1DU7 from the Protein Databank (PDB).
Figure 2:
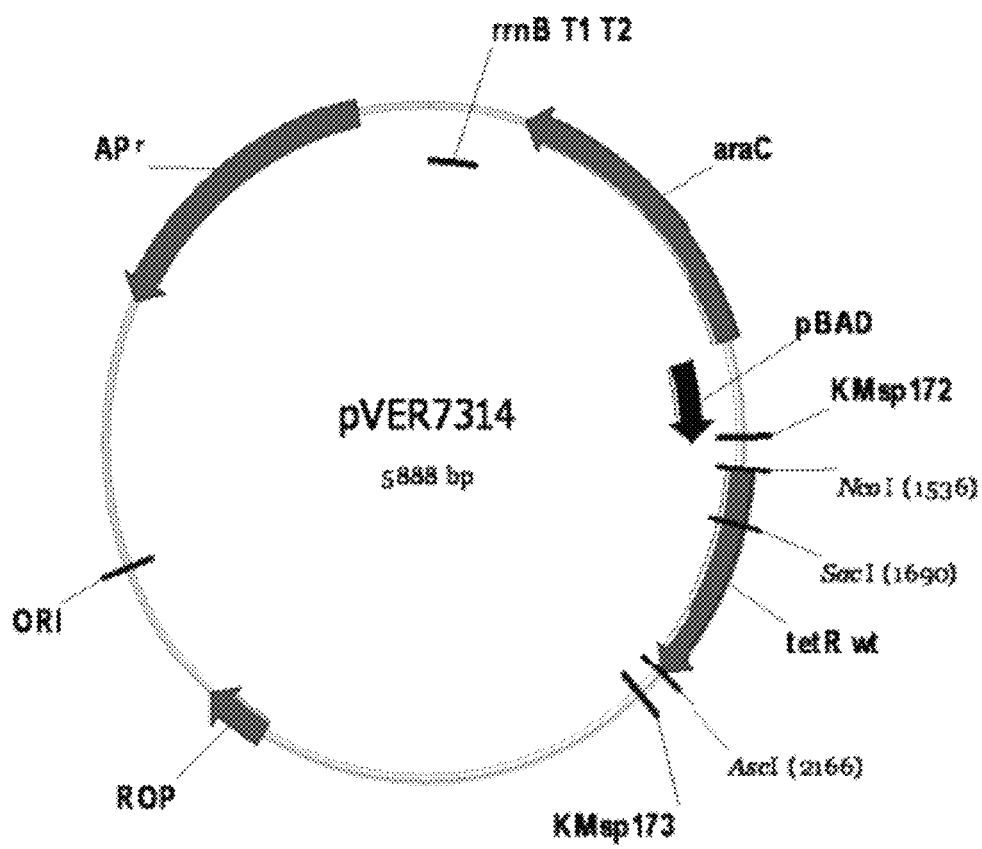
FIG. 2. Vector map of an exemplary *E. coli*-based tetR expression vector, pVER7314. The replicon backbone is based on that of pBR322. The TetR ligand binding domain (LBD) is encoded flanked by SacI and AscI sites. KMsp172 and KMsp173 represent binding sites for the primers used for DNA sequencing of inserted tetR genes. rrnB T1 T2 is a strong transcriptional terminator to inhibit run around transcription and unregulated tetR expression.

Chemically regulated expression tools have proven valuable for studying gene function and regulation in many biological systems. These systems allow testing for the effect of expression of any gene of interest in a culture system or whole organism when the transgene cannot be specifically regulated, or continuously expressed due to negative consequences. These systems essentially provide the opportunity to do "pulse" or "pulse-chase" gene expression testing. A chemical switch-mediated expression system allows testing of genomic, proteomic, and/or metabolomic responses immediately following activation of the target gene. These types of tests cannot be done with constitutive, developmental, or tissue-specific expression systems. Chemical switch technologies may also provide a means for gene therapy.

Chemical switch systems can be commercially applied, such as in agricultural biotechnology. For agricultural purposes it is desired to be able to control the expression and/or genetic flow of transgenes in the environment, such as herbicide resistance genes, especially in cases where weedy relatives of the target crop exist. In addition, having a family of viable chemical switch mechanisms would enable trait inventory management from a single transgenic crop, for example, one production line could be used to deliver selected traits on customer demand via specific chemical activation. Additionally, hybrid seed production could be streamlined by using chemical control of hybrid maintenance.

The Tet repressor (TetR) based genetic switch system widely used in animal systems has had limited use in plant genetic systems, due in part to problems with the activator ligands. TetR has been redesigned to recognize commercially used sulfonylurea chemistry instead of tetracycline compounds, while retaining the ability to specifically bind tetracycline operator sequences. This was accomplished by modifying the Tet repressor ligand binding domain using rational protein modeling and DNA shuffling to recognize commercially used sulfonylurea compounds. Initial TetR shuffling and screening using a sensitive in vivo β-galactosidase assay led to specific recognition of the herbicide Harmony® (thifensulfuron-methyl) at 20 ppm in the growth medium, and loss of recognition of tetracycline. Upon testing with other sulfonylurea compounds, many of the hits reactive to Harmony® also responded to other SU compounds. In some cases, the hits had even better reactivity to related herbicides chlorsulfuron and ethametsulfuron (2 ppm). Further rounds of shuffling and screening of the TetR derivatives led to TetR variants that react robustly to 0.2 ppm chlorsulfuron and 0.02 ppm ethametsulfuron as measured using in vivo induction assays in *E. coli*. Top performing ethametsulfuron responsive SuR variants (EsRs) show induction capacity nearly equal to that of wild type class B TetR induction by anhydrotetracycline (atc) using similar inducer concentrations. These SuR molecules have no reactivity to tetracyclines, and wild type TetR(B) (SEQ ID NO: 2) has no reactivity to the sulfonylureas.

Compositions and methods relating to the use of sulfonylurea-responsive repressors are provided. Sulfonylurea-responsive repressors (SuRs) include any repressor polypeptide whose binding to an operator sequence is controlled by a ligand comprising a sulfonylurea compound. In some examples, the repressor binds specifically to the operator in the absence of a sulfonylurea ligand. In some examples, the repressor binds specifically to the operator in the presence of a sulfonylurea ligand. Repressors that bind to an operator in the presence of the ligand are sometimes called a reverse repressor. In some examples compositions include SuR polypeptides that specifically bind to a tetracycline operator, wherein the specific binding is regulated by a sulfonylurea compound. In some examples compositions include an isolated sulfonylurea repressor (SuR) polypeptide comprising at least one amino acid substitution to a wild type tetracycline repressor protein ligand binding domain wherein the SuR polypeptide, or a multimer thereof, specifically binds to a polynucleotide comprising an operator sequence, wherein repressor-operator binding is regulated by the absence or presence of a sulfonylurea compound. In some examples compositions included isolated sulfonylurea repressors comprising a ligand binding domain comprising at least one amino acid substitution to a wild type tetracycline repressor protein ligand binding domain fused to a heterologous operator DNA binding domain which specifically binds to a polynucleotide comprising the operator sequence or derivative thereof, wherein repressor-operator binding is regulated by the absence or presence of a sulfonylurea compound. Any operator DNA binding domain can be used, including but not limited to an operator DNA binding domain from repressors included tet, lac, trp, phd, arg, LexA, phiCh1 repressor, lambda C1 and Cro repressors, phage X repressor, MetJ, phir1t rro, phi434 C1 and Cro repressors, RafR, gal, ebg, uxuR, exuR, ROS, SinR, PurR, FruR, P22 C2, TetC, AcrR, BetI, Bm3R1, EnvR, QacR, MtrR, TcmR, Ttk, YbiH, YhgD, and mu Ner, or DNA binding domains in Interpro families including but not limited to IPR001647, IPR010982, and IPR011991.

In some examples compositions include an isolated sulfonylurea repressor (SuR) polypeptides comprising at least one amino acid substitution to a wild type tetracycline repressor protein wherein the SuR polypeptide, or a multimer thereof, specifically binds to a polynucleotide comprising a tetracycline operator sequence, wherein repressor-operator binding is regulated by the absence or presence of a sulfonylurea compound.

Wild type repressors include tetracycline class A, B, C, D, E, G, H, J and Z repressors. An example of the TetR(A) class is found on the Tn1721 transposon and deposited under GenBank accession X61307, crossreferenced under gi48198, with encoded protein accession CAA43639, crossreferenced under gi48195 and UniProt accession Q56321. An example of the TetR(B) class is found on the Tn10 transposon and deposited under GenBank accession X00694, crossreferenced under gi43052, with encoded protein accession CAA25291, crossreferenced under gi43052 and UniProt accession P04483. An example of the TetR(C) class is found on the pSC101 plasmid and deposited under GenBank Accession M36272, crossreferenced under gi150945, with encoded protein accession AAA25677, crossreferenced under gi150946. An example of the TetR(D) class is found in *Salmonella ordonez* and deposited under GenBank Accession X65876, crossreferenced under gi49073, with encoded protein accession CAA46707, crossreferenced under gi49075 and UniProt accessions P0ACT5 and P09164. An example of the TetR(E) class was isolated from *E. coli* transposon Tn10 and deposited under GenBank Accession M34933, crossreferenced under gi155019, with encoded protein accession AAA98409, crossreferenced under gi155020. An example of the TetR(G) class was isolated from *Vibrio anguillarium* and deposited under GenBank Accession S52438, crossreferenced under gi262928, with encoded protein accession AAB24797, crossreferenced under gi262929. An example of the TetR(H) class is found on plasmid pMV111 isolated from *Pasteurella multocida* and deposited under GenBank Accession U00792, crossreferenced under gi392871, with encoded protein accession AAC43249, crossreferenced under gi392872. An example of the TetR(J) class was isolated from *Proteus mirabilis* and deposited under GenBank Accession AF038993, crossreferenced under gi4104704, with encoded protein accession AAD12754, crossreferenced under gi4104706. An example of the TetR(Z) class was found on plasmid pAGI isolated from *Corynebacterium glutamicum* and deposited under GenBank Accession AF121000, cross-referenced under gi4583389, with encoded protein accession AAD25064, crossreferenced under gi4583390. In some examples the wild type tetracycline repressor is a class B tetracycline repressor protein. In some examples the wild type tetracycline repressor is a class D tetracycline repressor protein.

In some examples the sulfonylurea repressor (SuR) polypeptides comprise an amino acid substitution in the ligand binding domain of a wild type tetracycline repressor protein. In class B and D wild type TetR proteins, amino acid residues 6-52 represent the DNA binding domain. The remainder of the protein is involved in ligand binding and subsequent allosteric modification. For class B TetR residues 53-207 represent the ligand binding domain, while residues 53-218 comprise the ligand binding domain for the class D TetR. In some examples the SuR polypeptides comprise an amino acid substitution in the ligand binding domain of a wild type TetR(B) protein. In some examples the SuR polypeptides comprise an amino acid substitution in the ligand binding domain of a wild type TetR(B) protein of SEQ ID NO: 1.

Figure 9:
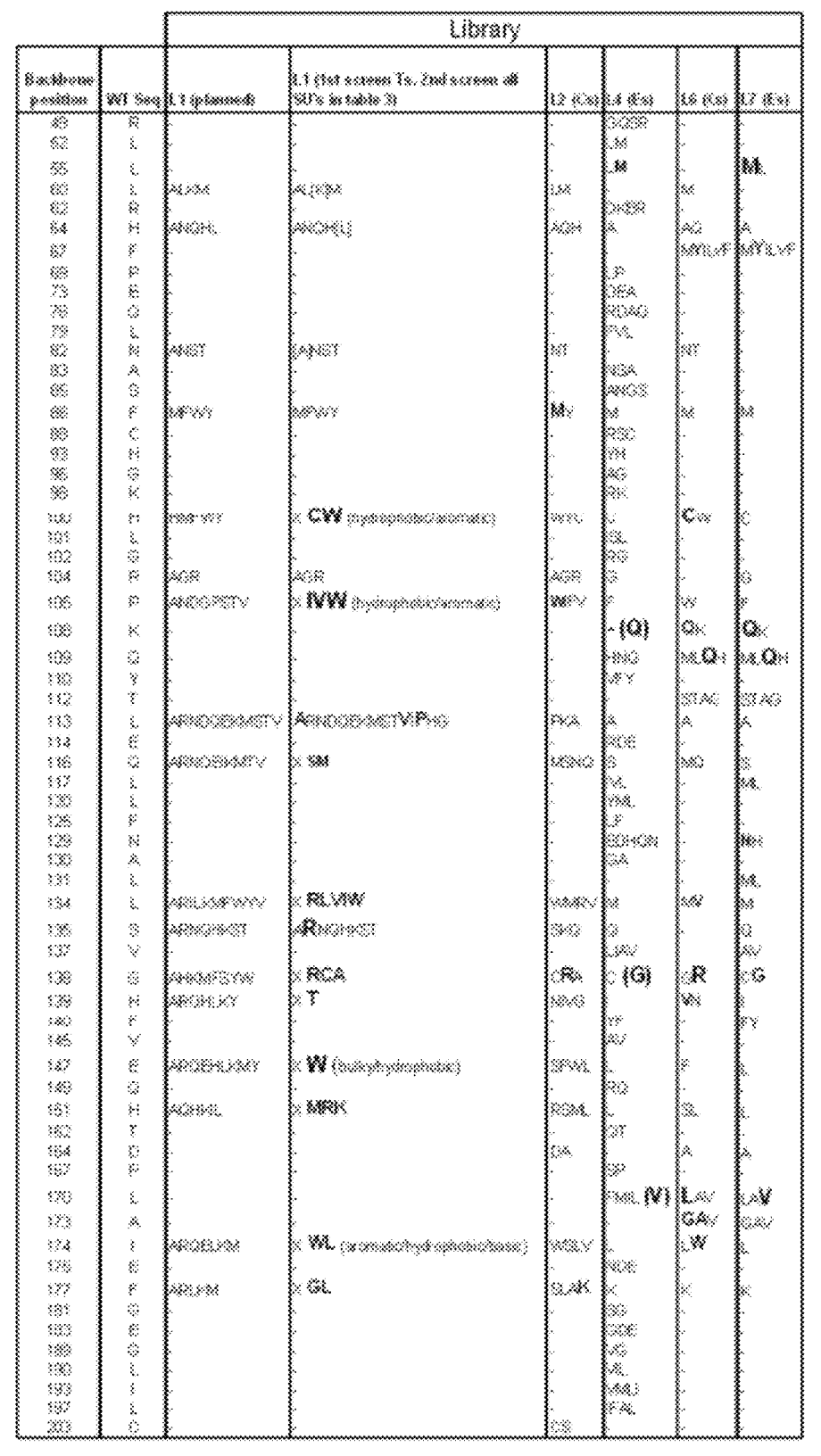

In some examples the isolated SuR polypeptides comprise an amino acid, or any combination of amino acids, corresponding to equivalent amino acid positions selected from the amino acid diversity shown in FIG. 9, wherein the amino acid residue position shown in FIG. 9 corresponds to the amino acid numbering of a wild type TetR(B). In some examples the isolated SuR polypeptides comprise a ligand binding domain comprising at least 10%, 20%, 30%, 40%, 50%, 55%, 60%, 65%, 66%, 67%, 68%, 69%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, 99% or 100% of the amino acid residues shown in FIG. 9, wherein the amino acid residue position corresponds to the equivalent position using the amino acid numbering of a wild type TetR(B). In some examples the isolated SuR polypeptides comprise at least 10%, 20%, 30%, 40%, 50%, 55%, 60%, 65%, 66%, 67%, 68%, 69%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, 99% or 100% of the amino acid residues shown in FIG. 9, wherein the amino acid residue position corresponds to the equivalent position using the amino acid numbering of a wild type TetR(B). In some examples the wild type TetR(B) is SEQ ID NO: 1.

In some examples the isolated SuR polypeptide comprises a ligand binding domain comprising an amino acid substitution at a residue position selected from the group consisting of position 55, 60, 64, 67, 82, 86, 100, 104, 105, 108, 113, 116, 134, 135, 138, 139, 147, 151, 170, 173, 174, 177 and any combination thereof, wherein the amino acid residue position and substitution corresponds to the equivalent position using the amino acid numbering of a wild type TetR(B). In some examples the isolated SuR polypeptide further comprises an amino acid substitution at a residue position selected from the group consisting of 109, 112, 117, 131, 137, 140, 164 and any combination thereof. In some examples the wild type TetR(B) is SEQ ID NO: 1.

In some examples the isolated SuR polypeptides comprise a ligand binding domain comprising at least 10%, 20%, 30%, 40%, 50%, 55%, 60%, 65%, 66%, 67%, 68%, 69%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, 99% or 100% of the amino acid residues selected from the group consisting of:
(a) M or L at amino acid residue position 55;
(b) A, L or M at amino acid residue position 60;
(c) A, N, Q, L or H at amino acid residue position 64;
(d) M, I, L, V, F or Y at amino acid residue position 67;
(e) N, S or T at amino acid residue position 82;
(f) F, M, W or Y at amino acid residue position 86;
(g) C, V, L, M, F, W or Y at amino acid residue position 100;
(h) R, A or G at amino acid residue position 104
(i) A, I, V, F or W at amino acid residue position 105;
(j) Q or K at amino acid residue position 108;
(k) A, M, H, K, T, P or V at amino acid residue position 113;
(l) I, L, M, V, R, S, N, P or Q at amino acid residue position 116;
(m) I, L, V, M, R, S or W at amino acid residue position 134;
(n) R, S, N, Q, K or A at amino acid residue position 135;
(o) A, C, G, H, I, V, R or T at amino acid residue position 138;
(p) A, G, I, V, M, W, N, R or T at amino acid residue position 139;
(q) I, L, V, F, W, T, S or R at amino acid residue position 147;
(r) M, L, W, Y, K, R or S at amino acid residue position 151;
(s) I, L, V or A at amino acid residue position 170;
(t) A, G or V at amino acid residue position 173;
(u) L, V, W, Y, H, R, K or S at amino acid residue position 174; and,
(v) A, G, I, L, Y, K, Q or S at amino acid residue position 177,
wherein the amino acid residue position corresponds to the equivalent position using the amino acid numbering of wild type TetR(B). In some examples the isolated SuR polypeptides comprise at least 10%, 20%, 30%, 40%, 50%, 55%, 60%, 65%, 66%, 67%, 68%, 69%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, 99% or 100% of the amino acid residues are selected from the amino acid residues listed in (a)-(v) above, wherein the amino acid residue position corresponds to the equivalent position using the amino acid numbering of wild type TetR(B). In some examples the wild type TetR(B) is SEQ ID NO: 1.

In some examples the isolated SuR polypeptides selected for enhanced activity on chlorsulfuron comprise a ligand binding domain comprising at least 10%, 20%, 30%, 40%, 50%, 55%, 60%, 65%, 66%, 67%, 68%, 69%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, 99% or 100% of the amino acid residues are selected from the group consisting of:
(a) M at amino acid residue position 60;
(b) A or Q at amino acid residue position 64;
(c) M, F, Y, I, V or L at amino acid residue position 67;
(d) N or T at amino acid residue position 82;
(e) M at amino acid residue position 86;
(f) C or W at amino acid residue position 100;
(g) W at amino acid residue position 105;
(h) Q or K at amino acid residue position 108;
(i) M, Q, L or H at amino acid residue position 109;
(j) G, A, S or T at amino acid residue position 112;
(k) A at amino acid residue position 113;
(l) M or Q at amino acid residue position 116;
(m) M or V at amino acid residue position 134;
(n) G or R at amino acid residue position 138;
(o) N or V at amino acid residue position 139;
(p) F at amino acid residue position 147;

(q) S or L at amino acid residue position 151;
(r) A at amino acid residue position 164;
(s) A, L or V at amino acid residue position 170;
(t) A, G or V at amino acid residue position 173;
(u) L or W at amino acid residue position 174; and;
(v) K at amino acid residue position 177, wherein the amino acid residue position corresponds to the equivalent position using the amino acid numbering of wild type TetR(B). In some examples the isolated SuR polypeptides comprise at least 10%, 20%, 30%, 40%, 50%, 55%, 60%, 65%, 66%, 67%, 68%, 69%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, 99% or 100% of the amino acid residues are selected from the amino acid residues listed in (a)-(v) above, wherein the amino acid residue position corresponds to the equivalent position using the amino acid numbering of wild type TetR(B). In some examples the wild type TetR(B) is SEQ ID NO: 1.

In some examples the isolated SuR polypeptides selected for enhanced activity on ethametsulfuron comprise a ligand binding domain comprising at least 10%, 20%, 30%, 40%, 50%, 55%, 60%, 65%, 66%, 67%, 68%, 69%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, 99% or 100% the amino acid residues are selected from the group consisting of:

(a) M or L at amino acid residue position 55;
(b) A at amino acid residue position 64;
(c) M, Y, F, I, L or V at amino acid residue position 67;
(d) M at amino acid residue position 86;
(e) C at amino acid residue position 100;
(f) G at amino acid residue position 104;
(g) F at amino acid residue position 105;
(h) Q or K at amino acid residue position 108;
(i) Q, M, L or H at amino acid residue position 109;
(j) S, T, G or A at amino acid residue position 112;
(k) A at amino acid residue position 113;
(l) S at amino acid residue position 116;
(m) M or L at amino acid residue position 117;
(n) M or L at amino acid residue position 131;
(o) M at amino acid residue position 134;
(p) Q at amino acid residue position 135;
(q) A or V at amino acid residue position 137;
(r) C or G at amino acid residue position 138;
(s) I at amino acid residue position 139;
(t) F or Y at amino acid residue position 140;
(u) L at amino acid residue position 147;
(v) L at amino acid residue position 151;
(w) A at amino acid residue position 164;
(x) V, A or L at amino acid residue position 170;
(y) G, A or V at amino acid residue position 173
(z) L at amino acid residue position 174; and,
(aa) N or K at amino acid residue position 177, wherein the amino acid residue position corresponds to the equivalent position using the amino acid numbering of wild type TetR(B). In some examples the isolated SuR polypeptides comprise at least 10%, 20%, 30%, 40%, 50%, 55%, 60%, 65%, 66%, 67%, 68%, 69%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, 99% or 100% the amino acid residues are selected from the amino acid residues listed in (a)-(aa) above, wherein the amino acid residue position corresponds to the equivalent position using the amino acid numbering of wild type TetR(B). In some examples the wild type TetR(B) is SEQ ID NO: 1.

In some examples the isolated SuR polypeptide has at least about 50% 60%, 65%, 66%, 67%, 68%, 69%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98% or 99% sequence identity to the ligand binding domain of a wild type TetR(B) exemplified by amino acid residues 53-207 of SEQ ID NO: 1, wherein the sequence identity is determined over the full length of the ligand binding domain using a global alignment method. In some examples the global alignment method uses the GAP algorithm with default parameters for an amino acid sequence % identity and % similarity using GAP Weight of 8 and Length Weight of 2, and the BLOSUM62 scoring matrix.

In some examples the isolated SuR polypeptide has at least about 50% 60%, 65%, 66%, 67%, 68%, 69%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98% or 99% sequence identity to a wild type TetR(B) exemplified by SEQ ID NO: 1, wherein the sequence identity is determined over the full length of the polypeptide using a global alignment method. In some examples the global alignment method uses the GAP algorithm with default parameters for an amino acid sequence % identity and % similarity using GAP Weight of 8 and Length Weight of 2, and the BLOSUM62 scoring matrix.

Compositions include isolated SuR polypeptides having at least about 50% 60%, 65%, 66%, 67%, 68%, 69%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98% or 99% sequence identity to the ligand binding domain of an SuR polypeptide selected from the group consisting of SEQ ID NO: 3-401, 1206-1213, 1228-1233, or 1240-1243, wherein the sequence identity is determined over the full length of the ligand binding domain using a global alignment method. In some examples the global alignment method uses the GAP algorithm with default parameters for an amino acid sequence % identity and % similarity using GAP Weight of 8 and Length Weight of 2, and the BLOSUM62 scoring matrix.

In some examples the isolated SuR polypeptide have at least about 50% 60%, 65%, 66%, 67%, 68%, 69%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98% or 99% sequence identity to an SuR polypeptide selected from the group consisting of SEQ ID NO: 3-401, 1206-1213, 1228-1233, or 1240-1243, wherein the sequence identity is determined over the full length of the polypeptide using a global alignment method. In some examples the global alignment method uses the GAP algorithm with default parameters for an amino acid sequence % identity and % similarity using GAP Weight of 8 and Length Weight of 2, and the BLOSUM62 scoring matrix.

In some examples the SuR polypeptides comprise an amino acid sequence that can be optimally aligned with a polypeptide sequence of L7-1A04 (SEQ ID NO:220) to generate a BLAST bit score of at least 200, 250, 275, 300, 325, 350, 375, 400, 425, 450, 475, 500, 525, 550, 575, 600, 625, 650, 675, 700, or 750, wherein the BLAST alignment used the BLOSUM62 matrix, a gap existence penalty of 11, and a gap extension penalty of 1. In some examples the SuR polypeptides comprise an amino acid sequence that can be optimally aligned with a polypeptide sequence of L7-1A04 (SEQ ID NO:220) to generate a BLAST bit score of at least 374, wherein the BLAST alignment used the BLOSUM62 matrix, a gap existence penalty of 11, and a gap extension penalty of 1. In some examples the SuR polypeptides comprise an amino acid sequence that can be optimally aligned with a polypeptide sequence of L7-1A04 (SEQ ID NO:220) to generate a percent sequence identity of at least 50% 60%, 65%, 66%, 67%, 68%, 69%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98% or 99% sequence identity, wherein the sequence identity is determined by BLAST alignment using the BLOSUM62 matrix, a gap existence penalty of 11, and a gap extension penalty of 1. In some examples the SuR polypeptides comprise an amino acid sequence that can be optimally aligned with a polypeptide sequence of L7-1A04 (SEQ ID NO:220) to generate a percent sequence identity of at least 88% sequence identity, wherein the sequence identity is determined by BLAST alignment using the BLOSUM62 matrix, a gap existence penalty of 11, and a gap extension penalty of 1. In some examples the percent identity is determined using a global alignment method using the GAP algorithm with default parameters for an amino acid sequence % identity and % similarity using GAP Weight of 8 and Length Weight of 2, and the BLOSUM62 scoring matrix. In some examples the SuR polypeptides comprise an amino acid sequence that can be optimally aligned with a polypeptide sequence of L7-1A04 (SEQ ID NO:220) to generate a BLAST similarity score of at least 400, 425, 450, 475, 500, 525, 550, 575, 600, 625, 650, 675, 700, 750, 800, 850, 900, 910, 920, 930, 940, 950, 960, 970, 980, 990, 1000, 1010, 1020, 1030, 1040, 1050, 1060, 1070, 1080, 1090, 1100, 1110, 1120, 1130, 1140, 1150, 1160, 1170, 1180, 1190, or 1200 wherein the BLAST alignment used the BLOSUM62 matrix, a gap existence penalty of 11, and a gap extension penalty of 1. In some examples the SuR polypeptides comprise an amino acid sequence that can be optimally aligned with a polypeptide sequence of L7-1A04 (SEQ ID NO:220) to generate a BLAST e-value score of at least e-60, e-70, e-75, e-80, e-85, e-90, e-95, e-100, e-105, e-106, e-107, e-108, e-109, e-110, e-111, e-112, e-113, e-114, e-115, e-116, e-117, e-118, e-119, e-120, or e-125, wherein the BLAST alignment used the BLOSUM62 matrix, a gap existence penalty of 11, and a gap extension penalty of 1. In some examples the polypeptide is selected from the group consisting of SEQ ID NO: 3-401, 1206-1213, 1228-1233, or 1240-1243.

In some examples the SuR polypeptides comprise an amino acid sequence that can be optimally aligned with a polypeptide sequence of L1-22 (SEQ ID NO: 7) to generate a BLAST bit score of at least 200, 250, 275, 300, 325, 350, 375, 400, 425, 450, 475, 500, 525, 550, 575, 600, 625, 650, 675, 700, or 750, wherein the BLAST alignment used the BLOSUM62 matrix, a gap existence penalty of 11, and a gap extension penalty of 1. In some examples the SuR polypeptides comprise an amino acid sequence that can be optimally aligned with a polypeptide sequence of L1-22 (SEQ ID NO: 7) to generate a BLAST bit score of at least 387, wherein the BLAST alignment used the BLOSUM62 matrix, a gap existence penalty of 11, and a gap extension penalty of 1. In some examples the SuR polypeptides comprise an amino acid sequence that can be optimally aligned with a polypeptide sequence of L1-22 (SEQ ID NO: 7) to generate a percent sequence identity of at least 50% 60%, 65%, 66%, 67%, 68%, 69%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98% or 99% sequence identity, wherein the sequence identity is determined by BLAST alignment using the BLOSUM62 matrix, a gap existence penalty of 11, and a gap extension penalty of 1. In some examples the SuR polypeptides comprise an amino acid sequence that can be optimally aligned with a polypeptide sequence of L1-22 (SEQ ID NO: 7) to generate a percent sequence identity of at least 92% sequence identity, wherein the sequence identity is determined by BLAST alignment using the BLOSUM62 matrix, a gap existence penalty of 11, and a gap extension penalty of 1. In some examples the percent identity is determined using a global alignment method using the GAP algorithm with default parameters for an amino acid sequence % identity and % similarity using GAP Weight of 8 and Length Weight of 2, and the BLOSUM62 scoring matrix. In some examples the SuR polypeptides comprise an amino acid sequence that can be optimally aligned with a polypeptide sequence of L1-22 (SEQ ID NO: 7) to generate a BLAST similarity score of at least 400, 425, 450, 475, 500, 525, 550, 575, 600, 625, 650, 675, 700, 750, 800, 850, 900, 910, 920, 930, 940, 950, 960, 970, 980, 990, 1000, 1010, 1020, 1030, 1040, 1050, 1060, 1070, 1080, 1090, 1100, 1110, 1120, 1130, 1140, 1150, 1160, 1170, 1180, 1190, or 1200 wherein the BLAST alignment used the BLOSUM62 matrix, a gap existence penalty of 11, and a gap extension penalty of 1. In some examples the SuR polypeptides comprise an amino acid sequence that can be optimally aligned with a polypeptide sequence of L1-22 (SEQ ID NO: 7) to generate a BLAST e-value score of at least e-60, e-70, e-75, e-80, e-85, e-90, e-95, e-100, e-105, e-106, e-107, e-108, e-109, e-110, e-111, e-112, e-113, e-114, e-115, e-116, e-117, e-118, e-119, e-120, or e-125, wherein the BLAST alignment used the BLOSUM62 matrix, a gap existence penalty of 11, and a gap extension penalty of 1. In some examples the polypeptide is selected from the group consisting of SEQ ID NO: 3-401, 1206-1213, 1228-1233, or 1240-1243.

In some examples the SuR polypeptides comprise an amino acid sequence that can be optimally aligned with a polypeptide sequence of L1-29 (SEQ ID NO: 10) to generate a BLAST bit score of at least 200, 250, 275, 300, 325, 350, 375, 400, 425, 450, 475, 500, 525, 550, 575, 600, 625, 650, 675, 700, or 750, wherein the BLAST alignment used the BLOSUM62 matrix, a gap existence penalty of 11, and a gap extension penalty of 1. In some examples the SuR polypeptides comprise an amino acid sequence that can be optimally aligned with a polypeptide sequence of L1-29 (SEQ ID NO: 10) to generate a BLAST bit score of at least 393, wherein the BLAST alignment used the BLOSUM62 matrix, a gap existence penalty of 11, and a gap extension penalty of 1. In some examples the SuR polypeptides comprise an amino acid sequence that can be optimally aligned with a polypeptide sequence of L1-29 (SEQ ID NO: 10) to generate a percent sequence identity of at least 50% 60%, 65%, 66%, 67%, 68%, 69%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98% or 99% sequence identity, wherein the sequence identity is determined by BLAST alignment using the BLOSUM62 matrix, a gap existence penalty of 11, and a gap extension penalty of 1. In some examples the percent identity is determined using a global alignment method using the GAP algorithm with default parameters for an amino acid sequence % identity and % similarity using GAP Weight of 8 and Length Weight of 2, and the BLOSUM62 scoring matrix. In some examples the SuR polypeptides comprise an amino acid sequence that can be optimally aligned with a polypeptide sequence of L1-29 (SEQ ID NO: 10) to generate a BLAST similarity score of at least 400, 425, 450, 475, 500, 525, 550, 575, 600, 625, 650, 675, 700, 750, 800, 850, 900, 910, 920, 930, 940, 950, 960, 970, 980, 990, 1000, 1010, 1020, 1030, 1040, 1050, 1060, 1070, 1080, 1090, 1100, 1110, 1120, 1130, 1140, 1150, 1160, 1170, 1180, 1190, or 1200 wherein the BLAST alignment used the BLOSUM62 matrix, a gap existence penalty of 11, and a gap extension penalty of 1. In some examples the SuR polypeptides comprise an amino acid sequence that can be optimally aligned with a polypeptide sequence of L1-29 (SEQ ID NO: 10) to generate a BLAST similarity score of at least 1006, wherein the BLAST alignment used the BLOSUM62 matrix, a gap existence penalty of 11, and a gap extension penalty of 1. In some examples the SuR polypeptides comprise an amino acid sequence that can be optimally aligned with a polypeptide sequence of L1-29 (SEQ ID NO: 10) to generate a BLAST e-value score of at least e-60, e-70, e-75, e-80, e-85, e-90, e-95, e-100, e-105, e-106, e-107, e-108, e-109, e-110, e-111, e-112, e-113, e-114, e-115, e-116, e-117, e-118, e-119, e-120, or e-125, wherein the BLAST alignment used the BLOSUM62 matrix, a gap existence penalty of 11, and a gap extension penalty of 1. In some examples the polypeptide is selected from the group consisting of SEQ ID NO: 3-401, 1206-1213, 1228-1233, or 1240-1243.

In some examples the SuR polypeptides comprise an amino acid sequence that can be optimally aligned with a polypeptide sequence of L1-02 (SEQ ID NO: 3) to generate a BLAST bit score of at least 200, 250, 275, 300, 325, 350, 375, 400, 425, 450, 475, 500, 525, 550, 575, 600, 625, 650, 675, 700, or 750, wherein the BLAST alignment used the BLOSUM62 matrix, a gap existence penalty of 11, and a gap extension penalty of 1. In some examples the SuR polypeptides comprise an amino acid sequence that can be optimally aligned with a polypeptide sequence of L1-02 (SEQ ID NO: 3) to generate a percent sequence identity of at least 50% 60%, 65%, 66%, 67%, 68%, 69%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98% or 99% sequence identity, wherein the sequence identity is determined by BLAST alignment using the BLOSUM62 matrix, a gap existence penalty of 11, and a gap extension penalty of 1. In some examples the percent identity is determined using a global alignment method using the GAP algorithm with default parameters for an amino acid sequence % identity and % similarity using GAP Weight of 8 and Length Weight of 2, and the BLOSUM62 scoring matrix. In some examples the SuR polypeptides comprise an amino acid sequence that can be optimally aligned with a polypeptide sequence of L1-02 (SEQ ID NO: 3) to generate a BLAST similarity score of at least 400, 425, 450, 475, 500, 525, 550, 575, 600, 625, 650, 675, 700, 750, 800, 850, 900, 910, 920, 930, 940, 950, 960, 970, 980, 990, 1000, 1010, 1020, 1030, 1040, 1050, 1060, 1070, 1080, 1090, 1100, 1110, 1120, 1130, 1140, 1150, 1160, 1170, 1180, 1190, or 1200 wherein the BLAST alignment used the BLOSUM62 matrix, a gap existence penalty of 11, and a gap extension penalty of 1. In some examples the SuR polypeptides comprise an amino acid sequence that can be optimally aligned with a polypeptide sequence of L1-02 (SEQ ID NO: 3) to generate a BLAST e-value score of at least e-60, e-70, e-75, e-80, e-85, e-90, e-95, e-100, e-105, e-106, e-107, e-108, e-109, e-110, e-111, e-112, e-113, e-114, e-115, e-116, e-117, e-118, e-119, e-120, or e-125, wherein the BLAST alignment used the BLOSUM62 matrix, a gap existence penalty of 11, and a gap extension penalty of 1. In some examples the SuR polypeptides comprise an amino acid sequence that can be optimally aligned with a polypeptide sequence of L1-02 (SEQ ID NO: 3) to generate a BLAST e-value score of at least e-112, wherein the BLAST alignment used the BLOSUM62 matrix, a gap existence penalty of 11, and a gap extension penalty of 1. In some examples the polypeptide is selected from the group consisting of SEQ ID NO: 3-401, 1206-1213, 1228-1233, or 1240-1243.

In some examples the SuR polypeptides comprise an amino acid sequence that can be optimally aligned with a polypeptide sequence of L1-07 (SEQ ID NO: 4) to generate a BLAST bit score of at least 200, 250, 275, 300, 325, 350, 375, 400, 425, 450, 475, 500, 525, 550, 575, 600, 625, 650, 675, 700, or 750, wherein the BLAST alignment used the BLOSUM62 matrix, a gap existence penalty of 11, and a gap extension penalty of 1. In some examples the SuR polypeptides comprise an amino acid sequence that can be optimally aligned with a polypeptide sequence of L1-07 (SEQ ID NO: 4) to generate a BLAST bit score of at least 388, wherein the BLAST alignment used the BLOSUM62 matrix, a gap existence penalty of 11, and a gap extension penalty of 1. In some examples the SuR polypeptides comprise an amino acid sequence that can be optimally aligned with a polypeptide sequence of L1-07 (SEQ ID NO: 4) to generate a percent sequence identity of at least 50% 60%, 65%, 66%, 67%, 68%, 69%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98% or 99% sequence identity, wherein the sequence identity is determined by BLAST alignment using the BLOSUM62 matrix, a gap existence penalty of 11, and a gap extension penalty of 1. In some examples the SuR polypeptides comprise an amino acid sequence that can be optimally aligned with a polypeptide sequence of L1-07 (SEQ ID NO: 4) to generate a percent sequence identity of at least 93% sequence identity, wherein the sequence identity is determined by BLAST alignment using the BLOSUM62 matrix, a gap existence penalty of 11, and a gap extension penalty of 1. In some examples the percent identity is determined using a global alignment method using the GAP algorithm with default parameters for an amino acid sequence % identity and % similarity using GAP Weight of 8 and Length Weight of 2, and the BLOSUM62 scoring matrix. In some examples the SuR polypeptides comprise an amino acid sequence that can be optimally aligned with a polypeptide sequence of L1-07 (SEQ ID NO: 4) to generate a BLAST similarity score of at least 400, 425, 450, 475, 500, 525, 550, 575, 600, 625, 650, 675, 700, 750, 800, 850, 900, 910, 920, 930, 940, 950, 960, 970, 980, 990, 1000, 1010, 1020, 1030, 1040, 1050, 1060, 1070, 1080, 1090, 1100, 1110, 1120, 1130, 1140, 1150, 1160, 1170, 1180, 1190, or 1200 wherein the BLAST alignment used the BLOSUM62 matrix, a gap existence penalty of 11, and a gap extension penalty of 1. In some examples the SuR polypeptides comprise an amino acid sequence that can be optimally aligned with a polypeptide sequence of L1-07 (SEQ ID NO: 4) to generate a BLAST similarity score of at least 996, wherein the BLAST alignment used the BLOSUM62 matrix, a gap existence penalty of 11, and a gap extension penalty of 1. In some examples the SuR polypeptides comprise an amino acid sequence that can be optimally aligned with a polypeptide sequence of L1-07 (SEQ ID NO: 4) to generate a BLAST e-value score of at least e-60, e-70, e-75, e-80, e-85, e-90, e-95, e-100, e-105, e-106, e-107, e-108, e-109, e-110, e-111, e-112, e-113, e-114, e-115, e-116, e-117, e-118, e-119, e-120, or e-125, wherein the BLAST alignment used the BLOSUM62 matrix, a gap existence penalty of 11, and a gap extension penalty of 1. In some examples the SuR polypeptides comprise an amino acid sequence that can be optimally aligned with a polypeptide sequence of L1-07 (SEQ ID NO: 4) to generate a BLAST e-value score of at least e-111, wherein the BLAST alignment used the BLOSUM62 matrix, a gap existence penalty of 11, and a gap extension penalty of 1. In some examples the polypeptide is selected from the group consisting of SEQ ID NO: 3-401, 1206-1213, 1228-1233, or 1240-1243.

In some examples the SuR polypeptides comprise an amino acid sequence that can be optimally aligned with a polypeptide sequence of L1-20 (SEQ ID NO: 6) to generate a BLAST bit score of at least 200, 250, 275, 300, 325, 350, 375, 400, 425, 450, 475, 500, 525, 550, 575, 600, 625, 650, 675, 700, or 750, wherein the BLAST alignment used the BLOSUM62 matrix, a gap existence penalty of 11, and a gap extension penalty of 1. In some examples the SuR polypeptides comprise an amino acid sequence that can be optimally aligned with a polypeptide sequence of L1-20 (SEQ ID NO: 6) to generate a percent sequence identity of at least 50% 60%, 65%, 66%, 67%, 68%, 69%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98% or 99% sequence identity, wherein the sequence identity is determined by BLAST alignment using the BLOSUM62 matrix, a gap existence penalty of 11, and a gap extension penalty of 1. In some examples the SuR polypeptides comprise an amino acid sequence that can be optimally aligned with a polypeptide sequence of L1-20 (SEQ ID NO: 6) to generate a percent sequence identity of at least 93% sequence identity, wherein the sequence identity is determined by BLAST alignment using the BLOSUM62 matrix, a gap existence penalty of 11, and a gap extension penalty of 1. In some examples the percent identity is determined using a global alignment method using the GAP algorithm with default parameters for an amino acid sequence % identity and % similarity using GAP Weight of 8 and Length Weight of 2, and the BLOSUM62 scoring matrix. In some examples the SuR polypeptides comprise an amino acid sequence that can be optimally aligned with a polypeptide sequence of L1-20 (SEQ ID NO: 6) to generate a BLAST similarity score of at least 400, 425, 450, 475, 500, 525, 550, 575, 600, 625, 650, 675, 700, 750, 800, 850, 900, 910, 920, 930, 940, 950, 960, 970, 980, 990, 1000, 1010, 1020, 1030, 1040, 1050, 1060, 1070, 1080, 1090, 1100, 1110, 1120, 1130, 1140, 1150, 1160, 1170, 1180, 1190, or 1200 wherein the BLAST alignment used the BLOSUM62 matrix, a gap existence penalty of 11, and a gap extension penalty of 1. In some examples the SuR polypeptides comprise an amino acid sequence that can be optimally aligned with a polypeptide sequence of L1-20 (SEQ ID NO: 6) to generate a BLAST e-value score of at least e-60, e-70, e-75, e-80, e-85, e-90, e-95, e-100, e-105, e-106, e-107, e-108, e-109, e-110, e-111, e-112, e-113, e-114, e-115, e-116, e-117, e-118, e-119, e-120, or e-125, wherein the BLAST alignment used the BLOSUM62 matrix, a gap existence penalty of 11, and a gap extension penalty of 1. In some examples the SuR polypeptides comprise an amino acid sequence that can be optimally aligned with a polypeptide sequence of L1-20 (SEQ ID NO: 6) to generate a BLAST e-value score of at least e-111, wherein the BLAST alignment used the BLOSUM62 matrix, a gap existence penalty of 11, and a gap extension penalty of 1. In some examples the polypeptide is selected from the group consisting of SEQ ID NO: 3-401, 1206-1213, 1228-1233, or 1240-1243.

In some examples the SuR polypeptides comprise an amino acid sequence that can be optimally aligned with a polypeptide sequence of L1-44 (SEQ ID NO: 13) to generate a BLAST bit score of at least 200, 250, 275, 300, 325, 350, 375, 400, 425, 450, 475, 500, 525, 550, 575, 600, 625, 650, 675, 700, or 750, wherein the BLAST alignment used the BLOSUM62 matrix, a gap existence penalty of 11, and a gap extension penalty of 1. In some examples the SuR polypeptides comprise an amino acid sequence that can be optimally aligned with a polypeptide sequence of L1-44 (SEQ ID NO: 13) to generate a percent sequence identity of at least 50% 60%, 65%, 66%, 67%, 68%, 69%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98% or 99% sequence identity, wherein the sequence identity is determined by BLAST alignment using the BLOSUM62 matrix, a gap existence penalty of 11, and a gap extension penalty of 1. In some examples the SuR polypeptides comprise an amino acid sequence that can be optimally aligned with a polypeptide sequence of L1-44 (SEQ ID NO: 13) to generate a percent sequence identity of at least 93% sequence identity, wherein the sequence identity is determined by BLAST alignment using the BLOSUM62 matrix, a gap existence penalty of 11, and a gap extension penalty of 1. In some examples the percent identity is determined using a global alignment method using the GAP algorithm with default parameters for an amino acid sequence % identity and % similarity using GAP Weight of 8 and Length Weight of 2, and the BLOSUM62 scoring matrix. In some examples the SuR polypeptides comprise an amino acid sequence that can be optimally aligned with a polypeptide sequence of L1-44 (SEQ ID NO: 13) to generate a BLAST similarity score of at least 400, 425, 450, 475, 500, 525, 550, 575, 600, 625, 650, 675, 700, 750, 800, 850, 900, 910, 920, 930, 940, 950, 960, 970, 980, 990, 1000, 1010, 1020, 1030, 1040, 1050, 1060, 1070, 1080, 1090, 1100, 1110, 1120, 1130, 1140, 1150, 1160, 1170, 1180, 1190, or 1200 wherein the BLAST alignment used the BLOSUM62 matrix, a gap existence penalty of 11, and a gap extension penalty of 1. In some examples the SuR polypeptides comprise an amino acid sequence that can be optimally aligned with a polypeptide sequence of L1-44 (SEQ ID NO: 13) to generate a BLAST e-value score of at least e-60, e-70, e-75, e-80, e-85, e-90, e-95, e-100, e-105, e-106, e-107, e-108, e-109, e-110, e-111, e-112, e-113, e-114, e-115, e-116, e-117, e-118, e-119, e-120, or e-125, wherein the BLAST alignment used the BLOSUM62 matrix, a gap existence penalty of 11, and a gap extension penalty of 1. In some examples the polypeptide is selected from the group consisting of SEQ ID NO: 3-401, 1206-1213, 1228-1233, or 1240-1243.

In some examples the SuR polypeptides comprise an amino acid sequence that can be optimally aligned with a polypeptide sequence of L6-3A09 (SEQ ID NO: 1228) to generate a BLAST bit score of at least 200, 250, 275, 300, 325, 350, 375, 400, 425, 450, 475, 500, 525, 550, 575, 600, 625, 650, 675, 700, or 750, wherein the BLAST alignment used the BLOSUM62 matrix, a gap existence penalty of 11, and a gap extension penalty of 1. In some examples the SuR polypeptides comprise an amino acid sequence that can be optimally aligned with a polypeptide sequence of L6-3A09 (SEQ ID NO: 1228) to generate a BLAST bit score of at least 381, wherein the BLAST alignment used the BLOSUM62 matrix, a gap existence penalty of 11, and a gap extension penalty of 1. In some examples the SuR polypeptides comprise an amino acid sequence that can be optimally aligned with a polypeptide sequence of L6-3A09 (SEQ ID NO: 1228) to generate a percent sequence identity of at least 50% 60%, 65%, 66%, 67%, 68%, 69%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98% or 99% sequence identity, wherein the sequence identity is determined by BLAST alignment using the BLOSUM62 matrix, a gap existence penalty of 11, and a gap extension penalty of 1. In some examples the percent identity is determined using a global alignment method using the GAP algorithm with default parameters for an amino acid sequence % identity and % similarity using GAP Weight of 8 and Length Weight of 2, and the BLOSUM62 scoring matrix. In some examples the SuR polypeptides comprise an amino acid sequence that can be optimally aligned with a polypeptide sequence of L6-3A09 (SEQ ID NO: 1228) to generate a BLAST similarity score of at least 400, 425, 450, 475, 500, 525, 550, 575, 600, 625, 650, 675, 700, 750, 800, 850, 900, 910, 920, 930, 940, 950, 960, 970, 980, 990, 1000, 1010, 1020, 1030, 1040, 1050, 1060, 1070, 1080, 1090, 1100, 1110, 1120, 1130, 1140, 1150, 1160, 1170, 1180, 1190, or 1200 wherein the BLAST alignment used the BLOSUM62 matrix, a gap existence penalty of 11, and a gap extension penalty of 1. In some examples the SuR polypeptides comprise an amino acid sequence that can be optimally aligned with a polypeptide sequence of L6-3A09 (SEQ ID NO: 1228) to generate a BLAST similarity score of at least 978 wherein the BLAST alignment used the BLOSUM62 matrix, a gap existence penalty of 11, and a gap extension penalty of 1. In some examples the SuR polypeptides comprise an amino acid sequence that can be optimally aligned with a polypeptide sequence of L6-3A09 (SEQ ID NO: 1228) to generate a BLAST e-value score of at least e-60, e-70, e-75, e-80, e-85, e-90, e-95, e-100, e-105, e-106, e-107, e-108, e-109, e-110, e-111, e-112, e-113, e-114, e-115, e-116, e-117, e-118, e-119, e-120, or e-125, wherein the BLAST alignment used the BLOSUM62 matrix, a gap existence penalty of 11, and a gap extension penalty of 1. In some examples the SuR polypeptides comprise an amino acid sequence that can be optimally aligned with a polypeptide sequence of L6-3A09 (SEQ ID NO: 1228) to generate a BLAST e-value score of at least e-108, wherein the BLAST alignment used the BLOSUM62 matrix, a gap existence penalty of 11, and a gap extension penalty of 1. In some examples the polypeptide is selected from the group consisting of SEQ ID NO: 3-401, 1206-1213, 1228-1233, or 1240-1243.

In some examples the SuR polypeptides comprise an amino acid sequence that can be optimally aligned with a polypeptide sequence of L6-3H02 (SEQ ID NO: 94) to generate a BLAST bit score of at least 200, 250, 275, 300, 325, 350, 375, 400, 425, 450, 475, 500, 525, 550, 575, 600, 625, 650, 675, 700, or 750, wherein the BLAST alignment used the BLOSUM62 matrix, a gap existence penalty of 11, and a gap extension penalty of 1. In some examples the SuR polypeptides comprise an amino acid sequence that can be optimally aligned with a polypeptide sequence of L6-3H02 (SEQ ID NO: 94) to generate a percent sequence identity of at least 50% 60%, 65%, 66%, 67%, 68%, 69%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98% or 99% sequence identity, wherein the sequence identity is determined by BLAST alignment using the BLOSUM62 matrix, a gap existence penalty of 11, and a gap extension penalty of 1. In some examples the SuR polypeptides comprise an amino acid sequence that can be optimally aligned with a polypeptide sequence of L6-3H02 (SEQ ID NO: 94) to generate a percent sequence identity of at least 90% sequence identity, wherein the sequence identity is determined by BLAST alignment using the BLOSUM62 matrix, a gap existence penalty of 11, and a gap extension penalty of 1. In some examples the percent identity is determined using a global alignment method using the GAP algorithm with default parameters for an amino acid sequence % identity and % similarity using GAP Weight of 8 and Length Weight of 2, and the BLOSUM62 scoring matrix. In some examples the SuR polypeptides comprise an amino acid sequence that can be optimally aligned with a polypeptide sequence of L6-3H02 (SEQ ID NO: 94) to generate a BLAST similarity score of at least 400, 425, 450, 475, 500, 525, 550, 575, 600, 625, 650, 675, 700, 750, 800, 850, 900, 910, 920, 930, 940, 950, 960, 970, 980, 990, 1000, 1010, 1020, 1030, 1040, 1050, 1060, 1070, 1080, 1090, 1100, 1110, 1120, 1130, 1140, 1150, 1160, 1170, 1180, 1190, or 1200 wherein the BLAST alignment used the BLOSUM62 matrix, a gap existence penalty of 11, and a gap extension penalty of 1. In some examples the SuR polypeptides comprise an amino acid sequence that can be optimally aligned with a polypeptide sequence of L6-3H02 (SEQ ID NO: 94) to generate a BLAST e-value score of at least e-60, e-70, e-75, e-80, e-85, e-90, e-95, e-100, e-105, e-106, e-107, e-108, e-109, e-110, e-111, e-112, e-113, e-114, e-115, e-116, e-117, e-118, e-119, e-120, or e-125, wherein the BLAST alignment used the BLOSUM62 matrix, a gap existence penalty of 11, and a gap extension penalty of 1. In some examples the polypeptide is selected from the group consisting of SEQ ID NO: 3-401, 1206-1213, 1228-1233, or 1240-1243.

In some examples the SuR polypeptides comprise an amino acid sequence that can be optimally aligned with a polypeptide sequence of L7-4E03 (SEQ ID NO: 1229) to generate a BLAST bit score of at least 200, 250, 275, 300, 325, 350, 375, 400, 425, 450, 475, 500, 525, 550, 575, 600, 625, 650, 675, 700, or 750, wherein the BLAST alignment used the BLOSUM62 matrix, a gap existence penalty of 11, and a gap extension penalty of 1. In some examples the SuR polypeptides comprise an amino acid sequence that can be optimally aligned with a polypeptide sequence of L7-4E03 (SEQ ID NO: 1229) to generate a BLAST bit score of at least 368, wherein the BLAST alignment used the BLOSUM62 matrix, a gap existence penalty of 11, and a gap extension penalty of 1. In some examples the SuR polypeptides comprise an amino acid sequence that can be optimally aligned with a polypeptide sequence of L7-4E03 (SEQ ID NO: 1229) to generate a percent sequence identity of at least 50% 60%, 65%, 66%, 67%, 68%, 69%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98% or 99% sequence identity, wherein the sequence identity is determined by BLAST alignment using the BLOSUM62 matrix, a gap existence penalty of 11, and a gap extension penalty of 1. In some examples the percent identity is determined using a global alignment method using the GAP algorithm with default parameters for an amino acid sequence % identity and % similarity using GAP Weight of 8 and Length Weight of 2, and the BLOSUM62 scoring matrix. In some examples the SuR polypeptides comprise an amino acid sequence that can be optimally aligned with a polypeptide sequence of L7-4E03 (SEQ ID NO: 1229) to generate a BLAST similarity score of at least 400, 425, 450, 475, 500, 525, 550, 575, 600, 625, 650, 675, 700, 750, 800, 850, 900, 910, 920, 930, 940, 950, 960, 970, 980, 990, 1000, 1010, 1020, 1030, 1040, 1050, 1060, 1070, 1080, 1090, 1100, 1110, 1120, 1130, 1140, 1150, 1160, 1170, 1180, 1190, or 1200 wherein the BLAST alignment used the BLOSUM62 matrix, a gap existence penalty of 11, and a gap extension penalty of 1. In some examples the SuR polypeptides comprise an amino acid sequence that can be optimally aligned with a polypeptide sequence of L7-4E03 (SEQ ID NO: 1229) to generate a BLAST similarity score of at least 945 wherein the BLAST alignment used the BLOSUM62 matrix, a gap existence penalty of 11, and a gap extension penalty of 1. In some examples the SuR polypeptides comprise an amino acid sequence that can be optimally aligned with a polypeptide sequence of L7-4E03 (SEQ ID NO: 1229) to generate a BLAST e-value score of at least e-60, e-70, e-75, e-80, e-85, e-90, e-95, e-100, e-105, e-106, e-107, e-108, e-109, e-110, e-111, e-112, e-113, e-114, e-115, e-116, e-117, e-118, e-119, e-120, or e-125, wherein the BLAST alignment used the BLOSUM62 matrix, a gap existence penalty of 11, and a gap extension penalty of 1. In some examples the SuR polypeptides comprise an amino acid sequence that can be optimally aligned with a polypeptide sequence of L7-4E03 (SEQ ID NO: 1229) to generate a BLAST e-value score of at least e-105, wherein the BLAST alignment used the BLOSUM62 matrix, a gap existence penalty of 11, and a gap extension penalty of 1. In some examples the polypeptide is selected from the group consisting of SEQ ID NO: 3-401, 1206-1213, 1228-1233, or 1240-1243.

In some examples the SuR polypeptides comprise an amino acid sequence that can be optimally aligned with a polypeptide sequence of L10-84(B12) (SEQ ID NO: 1230) to generate a BLAST bit score of at least 200, 250, 275, 300, 325, 350, 375, 400, 425, 450, 475, 500, 525, 550, 575, 600, 625, 650, 675, 700, or 750, wherein the BLAST alignment used the BLOSUM62 matrix, a gap existence penalty of 11, and a gap extension penalty of 1. In some examples the SuR polypeptides comprise an amino acid sequence that can be optimally aligned with a polypeptide sequence of L10-84 (B12) (SEQ ID NO: 1230) to generate a percent sequence identity of at least 50% 60%, 65%, 66%, 67%, 68%, 69%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98% or 99% sequence identity, wherein the sequence identity is determined by BLAST alignment using the BLOSUM62 matrix, a gap existence penalty of 11, and a gap extension penalty of 1. In some examples the SuR polypeptides comprise an amino acid sequence that can be optimally aligned with a polypeptide sequence of L10-84(B12) (SEQ ID NO: 1230) to generate a percent sequence identity of at least 86% sequence identity, wherein the sequence identity is determined by BLAST alignment using the BLOSUM62 matrix, a gap existence penalty of 11, and a gap extension penalty of 1. In some examples the percent identity is determined using a global alignment method using the GAP algorithm with default parameters for an amino acid sequence % identity and % similarity using GAP Weight of 8 and Length Weight of 2, and the BLOSUM62 scoring matrix. In some examples the SuR polypeptides comprise an amino acid sequence that can be optimally aligned with a polypeptide sequence of L10-84 (B12) (SEQ ID NO: 1230) to generate a BLAST similarity score of at least 400, 425, 450, 475, 500, 525, 550, 575, 600, 625, 650, 675, 700, 750, 800, 850, 900, 910, 920, 930, 940, 950, 960, 970, 980, 990, 1000, 1010, 1020, 1030, 1040, 1050, 1060, 1070, 1080, 1090, 1100, 1110, 1120, 1130, 1140, 1150, 1160, 1170, 1180, 1190, or 1200 wherein the BLAST alignment used the BLOSUM62 matrix, a gap existence penalty of 11, and a gap extension penalty of 1. In some examples the SuR polypeptides comprise an amino acid sequence that can be optimally aligned with a polypeptide sequence of L10-84 (B12) (SEQ ID NO: 1230) to generate a BLAST e-value score of at least e-60, e-70, e-75, e-80, e-85, e-90, e-95, e-100, e-105, e-106, e-107, e-108, e-109, e-110, e-111, e-112, e-113, e-114, e-115, e-116, e-117, e-118, e-119, e-120, or e-125, wherein the BLAST alignment used the BLOSUM62 matrix, a gap existence penalty of 11, and a gap extension penalty of 1. In some examples the polypeptide is selected from the group consisting of SEQ ID NO: 3-401, 1206-1213, 1228-1233, or 1240-1243.

In some examples the SuR polypeptides comprise an amino acid sequence that can be optimally aligned with a polypeptide sequence of L13-46 (SEQ ID NO: 1231) to generate a BLAST bit score of at least 200, 250, 275, 300, 325, 350, 375, 400, 425, 450, 475, 500, 525, 550, 575, 600, 625, 650, 675, 700, or 750, wherein the BLAST alignment used the BLOSUM62 matrix, a gap existence penalty of 11, and a gap extension penalty of 1. In some examples the SuR polypeptides comprise an amino acid sequence that can be optimally aligned with a polypeptide sequence of L13-46 (SEQ ID NO: 1231) to generate a BLAST bit score of at least 320, wherein the BLAST alignment used the BLOSUM62 matrix, a gap existence penalty of 11, and a gap extension penalty of 1. In some examples the SuR polypeptides comprise an amino acid sequence that can be optimally aligned with a polypeptide sequence of L13-46 (SEQ ID NO: 1231) to generate a percent sequence identity of at least 50% 60%, 65%, 66%, 67%, 68%, 69%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98% or 99% sequence identity, wherein the sequence identity is determined by BLAST alignment using the BLOSUM62 matrix, a gap existence penalty of 11, and a gap extension penalty of 1. In some examples the SuR polypeptides comprise an amino acid sequence that can be optimally aligned with a polypeptide sequence of L13-46 (SEQ ID NO: 1231) to generate a percent sequence identity of at least 86% sequence identity, wherein the sequence identity is determined by BLAST alignment using the BLOSUM62 matrix, a gap existence penalty of 11, and a gap extension penalty of 1. In some examples the percent identity is determined using a global alignment method using the GAP algorithm with default parameters for an amino acid sequence % identity and % similarity using GAP Weight of 8 and Length Weight of 2, and the BLOSUM62 scoring matrix. In some examples the SuR polypeptides comprise an amino acid sequence that can be optimally aligned with a polypeptide sequence of L13-46 (SEQ ID NO: 1231) to generate a BLAST similarity score of at least 400, 425, 450, 475, 500, 525, 550, 575, 600, 625, 650, 675, 700, 750, 800, 850, 900, 910, 920, 930, 940, 950, 960, 970, 980, 990, 1000, 1010, 1020, 1030, 1040, 1050, 1060, 1070, 1080, 1090, 1100, 1110, 1120, 1130, 1140, 1150, 1160, 1170, 1180, 1190, or 1200 wherein the BLAST alignment used the BLOSUM62 matrix, a gap existence penalty of 11, and a gap extension penalty of 1. In some examples the SuR polypeptides comprise an amino acid sequence that can be optimally aligned with a polypeptide sequence of L13-46 (SEQ ID NO: 1231) to generate a BLAST similarity score of at least 819 wherein the BLAST alignment used the BLOSUM62 matrix, a gap existence penalty of 11, and a gap extension penalty of 1. In some examples the SuR polypeptides comprise an amino acid sequence that can be optimally aligned with a polypeptide sequence of L13-46 (SEQ ID NO: 1231) to generate a BLAST e-value score of at least e-60, e-70, e-75, e-80, e-85, e-90, e-95, e-100, e-105, e-106, e-107, e-108, e-109, e-110, e-111, e-112, e-113, e-114, e-115, e-116, e-117, e-118, e-119, e-120, or e-125, wherein the BLAST alignment used the BLOSUM62 matrix, a gap existence penalty of 11, and a gap extension penalty of 1. In some examples the SuR polypeptides comprise an amino acid sequence that can be optimally aligned with a polypeptide sequence of L13-46 (SEQ ID NO: 1231) to generate a BLAST e-value score of at least e-90, wherein the BLAST alignment used the BLOSUM62 matrix, a gap existence penalty of 11, and a gap extension penalty of 1. In some examples the polypeptide is selected from the group consisting of SEQ ID NO: 3-401, 1206-1213, 1228-1233, or 1240-1243.

In some examples the isolated SuR polypeptides comprise a ligand binding domain from a polypeptide selected from the group consisting of SEQ ID NO: 3-401, 1206-1213, 1228-1233, or 1240-1243. In some examples the isolated SuR polypeptides comprise an amino acid sequence selected from the group consisting of SEQ ID NO: 3-401, 1206-1213, 1228-

1233, or 1240-1243. In some examples the isolated SuR polypeptide is selected from the group consisting of SEQ ID NO: 3-401, 1206-1213, 1228-1233, or 1240-1243, and the sulfonylurea compound is selected from the group consisting of a chlorsulfuron, an ethametsulfuron, a metsulfuron, a sulfometuron, a tribenuron, a chlorimuron, a nicosulfuron, a rimsulfuron and a thifensulfuron.

In some examples the isolated SuR polypeptides have an equilibrium binding constant for a sulfonylurea compound greater than 0.1 nM and less than 10 µM. In some examples the isolated SuR polypeptide has an equilibrium binding constant for a sulfonylurea compound of at least 0.1 nM, 0.5 nM, 1 nM, 10 nM, 50 nM, 100 nM, 250 nM, 500 nM, 750 nM, 1 µM, 5 µM, 7 µM but less than 10 µM. In some examples the isolated SuR polypeptide has an equilibrium binding constant for a sulfonylurea compound of at least 0.1 nM, 0.5 nM, 1 nM, 10 nM, 50 nM, 100 nM, 250 nM, 500 nM, 750 nM but less than 1 µM. In some examples the isolated SuR polypeptide has an equilibrium binding constant for a sulfonylurea compound greater than 0 nM, but less than 0.1 nM, 0.5 nM, 1 nM, 10 nM, 50 nM, 100 nM, 250 nM, 500 nM, 750 nM, 1 µM, 5 µM, 7 µM or 10 µM. In some examples the sulfonylurea compound is a chlorsulfuron, an ethametsulfuron, a metsulfuron, a sulfometuron, a tribenuron, a chlorimuron, a nicosulfuron, a rimsulfuron and/or a thifensulfuron.

In some examples the isolated SuR polypeptides have an equilibrium binding constant for an operator sequence greater than 0.1 nM and less than 10 µM. In some examples the isolated SuR polypeptide has an equilibrium binding constant for an operator sequence of at least 0.1 nM, 0.5 nM, 1 nM, 10 nM, 50 nM, 100 nM, 250 nM, 500 nM, 750 nM, 1 µM, 5 µM, 7 µM but less than 10 µM. In some examples the isolated SuR polypeptide has an equilibrium binding constant for an operator sequence of at least 0.1 nM, 0.5 nM, 1 nM, 10 nM, 50 nM, 100 nM, 250 nM, 500 nM, 750 nM but less than 1 µM. In some examples the isolated SuR polypeptide has an equilibrium binding constant for an operator sequence greater than 0 nM, but less than 0.1 nM, 0.5 nM, 1 nM, 10 nM, 50 nM, 100 nM, 250 nM, 500 nM, 750 nM, 1 µM, 5 µM, 7 µM or 10 µM. In some examples the operator sequence is a Tet operator sequence. In some examples the Tet operator sequence is a TetR(A) operator sequence, a TetR(B) operator sequence, a TetR(D) operator sequence, TetR(E) operator sequence, a TetR(H) operator sequence, or a functional derivative thereof.

The isolated SuR polypeptides specifically bind to a sulfonylurea compound. Sulfonylurea molecules comprise a sulfonylurea moiety (—S(O)2NHC(O)NH(R)—). In sulfonylurea herbicides the sulfonyl end of the sulfonylurea moiety is connected either directly or by way of an oxygen atom or an optionally substituted amino or methylene group to a typically substituted cyclic or acyclic group. At the opposite end of the sulfonylurea bridge, the amino group, which may have a substituent such as methyl (R being CH3) instead of hydrogen, is connected to a heterocyclic group, typically a symmetric pyrimidine or triazine ring, having one or two substituents such as methyl, ethyl, trifluoromethyl, methoxy, ethoxy, methylamino, dimethylamino, ethylamino and the halogens. Sulfonylurea herbicides can be in the form of the free acid or a salt. In the free acid form the sulfonamide nitrogen on the bridge is not deprotonated (i.e., —S(O)2NHC(O)NH(R)—), while in the salt form the sulfonamide nitrogen atom on the bridge is deprotonated (i.e., —S(O)2NC(O)NH(R)—), and a cation is present, typically of an alkali metal or alkaline earth metal, most commonly sodium or potassium. Sulfonylurea compounds include, for example, compound classes such as pyrimidinylsulfonylurea compounds, triazinylsulfonylurea compounds, thiadiazolylurea compounds, and pharmaceuticals such as antidiabetic drugs, as well as salts and other derivatives thereof. Examples of pyrimidinylsulfonylurea compounds include amidosulfuron, azimsulfuron, bensulfuron, bensulfuron-methyl, chlorimuron, chlorimuron-ethyl, cyclosulfamuron, ethoxysulfuron, flazasulfuron, flucetosulfuron, flupyrsulfuron, flupyrsulfuron-methyl, foramsulfuron, halosulfuron, halosulfuron-methyl, imazosulfuron, mesosulfuron, mesosulfuron-methyl, nicosulfuron, orthosulfamuron, oxasulfuron, primisulfuron, primisulfuron-methyl, pyrazosulfuron, pyrazosulfuron-ethyl, rimsulfuron, sulfometuron, sulfometuron-methyl, sulfosulfuron, trifloxysulfuron and salts and derivatives thereof. Examples of triazinylsulfonylurea compounds include chlorsulfuron, cinosulfuron, ethametsulfuron, ethametsulfuron-methyl, iodosulfuron, iodosulfuron-methyl, metsulfuron, metsulfuron-methyl, prosulfuron, thifensulfuron, thifensulfuron-methyl, triasulfuron, tribenuron, tribenuron-methyl, triflusulfuron, triflusulfuron-methyl, tritosulfuron and salts and derivatives thereof. Examples of thiadiazolylurea compounds include buthiuron, ethidimuron, tebuthiuron, thiazafluron, thidiazuron and salts and derivatives thereof. Examples of antidiabetic drugs include acetohexamide, chlorpropamide, tolbutamide, tolazamide, glipizide, gliclazide, glibenclamide (glyburide), gliquidone, glimepiride and salts and derivatives thereof. In some examples the isolated SuR polypeptides specifically bind to more than one sulfonylurea compound. In some examples the sulfonylurea compound is selected from the group consisting of chlorsulfuron, ethametsulfuron-methyl, metsulfuron-methyl, thifensulfuron-methyl, sulfometuron-methyl, tribenuron-methyl, chlorimuron-ethyl, nicosulfuron, and rimsulfuron.

Compositions also include isolated polynucleotides encoding SuR polypeptides that specifically bind to a tetracycline operator, wherein the specific binding is regulated by a sulfonylurea compound. In some examples the isolated polynucleotides encode sulfonylurea repressor (SuR) polypeptides comprising an amino acid substitution in the ligand binding domain of a wild type tetracycline repressor protein. In class B and D wild type TetR proteins, amino acid residues 6-52 represent the DNA binding domain. The remainder of the protein is involved in ligand binding and subsequent allosteric modification. For class B TetR residues 53-207 represent the ligand binding domain, while residues 53-218 comprise the ligand binding domain for the class D TetR. In some examples the isolated polynucleotides encode SuR polypeptides comprising an amino acid substitution in the ligand binding domain of a wild type TetR(B) protein. In some examples the polynucleotides encode SuR polypeptides comprising an amino acid substitution in the ligand binding domain of a wild type TetR(B) protein of SEQ ID NO: 1.

In some examples the isolated polynucleotides encode SuR polypeptides comprising an amino acid, or any combination of amino acids, selected from the amino acid diversity shown in FIG. 9, wherein the amino acid residue position corresponds to the equivalent position using the amino acid numbering of a wild type TetR(B) exemplified by SEQ ID NO: 1. In some examples the isolated polynucleotides encode SuR polypeptides comprising a ligand binding domain comprising at least 10%, 20%, 30%, 40%, 50%, 55%, 60%, 65%, 66%, 67%, 68%, 69%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, 99% or 100% of the amino acid residues shown in FIG. 9, wherein the amino acid residue position corresponds to the equivalent position using the amino acid numbering of wild type TetR(B). In some examples the isolated polynucleotides encode SuR polypeptides comprising at least 10%, 20%, 30%, 40%, 50%, 55%, 60%, 65%, 66%, 67%, 68%, 69%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, 99% or 100% of the amino acid residues shown in FIG. 9, wherein the amino acid residue position corresponds to the equivalent position using the amino acid numbering of wild type TetR(B). In some examples the wild type TetR(B) is SEQ ID NO: 1.

In some examples the isolated polynucleotides encode SuR polypeptides comprising a ligand binding domain comprising an amino acid substitution at a residue position selected from the group consisting of position 55, 60, 64, 67, 82, 86, 100, 104, 105, 108, 113, 116, 134, 135, 138, 139, 147, 151, 170, 173, 174, 177 and any combination thereof, wherein the amino acid residue position and substitution corresponds to the equivalent position using the amino acid numbering of a wild type TetR(B). In some examples the isolated polynucleotides encode SuR polypeptides further comprising an amino acid substitution at a residue position selected from the group consisting of 109, 112, 117, 131, 137, 140, 164 and any combination thereof. In some examples the wild type TetR(B) polypeptide sequence is SEQ ID NO: 1.

In some examples the isolated polynucleotides encode SuR polypeptides having a ligand binding domain comprising at least 10%, 20%, 30%, 40%, 50%, 55%, 60%, 65%, 66%, 67%, 68%, 69%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, 99% or 100% of the amino acid residues are selected from the group consisting of:
(a) M or L at amino acid residue position 55;
(b) A, L or M at amino acid residue position 60;
(c) A, N, Q, L or H at amino acid residue position 64;
(d) M, I, L, V, F or Y at amino acid residue position 67;
(e) N, S or T at amino acid residue position 82;
(f) F, M, W or Y at amino acid residue position 86;
(g) C, V, L, M, F, W or Y at amino acid residue position 100;
(h) R, A or G at amino acid residue position 104
(i) A, I, V, F or W at amino acid residue position 105;
(j) Q or K at amino acid residue position 108;
(k) A, M, H, K, T, P or V at amino acid residue position 113;
(l) I, L, M, V, R, S, N, P or Q at amino acid residue position 116;
(m) I, L, V, M, R, S or W at amino acid residue position 134;
(n) R, S, N, Q, K or A at amino acid residue position 135;
(o) A, C, G, H, I, V, R or T at amino acid residue position 138;
(p) A, G, I, V, M, W, N, R or T at amino acid residue position 139;
(q) I, L, V, F, W, T, S or R at amino acid residue position 147;
(r) M, L, W, Y, K, R or S at amino acid residue position 151;
(s) I, L, V or A at amino acid residue position 170;
(t) A, G or V at amino acid residue position 173;
(u) L, V, W, Y, H, R, K or S at amino acid residue position 174; and,
(v) A, G, I, L, Y, K, Q or S at amino acid residue position 177,
wherein the amino acid residue position corresponds to the equivalent position using the amino acid numbering of wild type TetR(B). In some examples the isolated SuR polynucleotides encode SuR polypeptides comprising at least 10%, 20%, 30%, 40%, 50%, 55%, 60%, 65%, 66%, 67%, 68%, 69%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, 99% or 100% of the amino acid residues are selected from the amino acid residues listed in (a)-(v) above, wherein the amino acid residue position corresponds to the equivalent position using the amino acid numbering of wild type TetR(B). In some examples the wild type TetR(B) is SEQ ID NO: 1.

In some examples the isolated polynucleotides encode SuR polypeptides selected for enhanced activity on chlorsulfuron having a ligand binding domain comprising at least 10%, 20%, 30%, 40%, 50%, 55%, 60%, 65%, 66%, 67%, 68%, 69%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, 99% or 100% of the amino acid residues are selected from the group consisting of:
(a) M at amino acid residue position 60;
(b) A or Q at amino acid residue position 64;
(c) M, F, Y, I, V or L at amino acid residue position 67;
(d) N or T at amino acid residue position 82;
(e) M at amino acid residue position 86;
(f) C or W at amino acid residue position 100;
(g) W at amino acid residue position 105;
(h) Q or K at amino acid residue position 108;
(i) M, Q, L or H at amino acid residue position 109;
(j) G, A, S or T at amino acid residue position 112;
(k) A at amino acid residue position 113;
(l) M or Q at amino acid residue position 116;
(m) M or V at amino acid residue position 134;
(n) G or R at amino acid residue position 138;
(o) N or V at amino acid residue position 139;
(p) F at amino acid residue position 147;
(q) S or L at amino acid residue position 151;
(r) A at amino acid residue position 164;
(s) A, L or V at amino acid residue position 170;
(t) A, G or V at amino acid residue position 173;
(u) L or W at amino acid residue position 174; and;
(v) K at amino acid residue position 177,
wherein the amino acid residue position corresponds to the equivalent position using the amino acid numbering of wild type TetR(B). In some examples the isolated SuR polynucleotides encode SuR polypeptides comprising at least 10%, 20%, 30%, 40%, 50%, 55%, 60%, 65%, 66%, 67%, 68%, 69%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, 99% or 100% of the amino acid residues are selected from the amino acid residues listed in (a)-(v) above wherein the amino acid residue position corresponds to the equivalent position using the amino acid numbering of wild type TetR(B). In some examples the wild type TetR(B) is SEQ ID NO: 1.

In some examples the isolated polynucleotides encode SuR polypeptides selected for enhanced activity on ethametsulfuron having a ligand binding domain comprising at least 10%, 20%, 30%, 40%, 50%, 55%, 60%, 65%, 66%, 67%, 68%, 69%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, 99% or 100% of the amino acid residues are selected from the group consisting of:
(a) M or L at amino acid residue position 55;
(b) A at amino acid residue position 64;
(c) M, Y, F, I, L or V at amino acid residue position 67;
(d) M at amino acid residue position 86;
(e) C at amino acid residue position 100;
(f) G at amino acid residue position 104;
(g) F at amino acid residue position 105;
(h) Q or K at amino acid residue position 108;
(i) Q, M, L or H at amino acid residue position 109;
(j) S, T, G or A at amino acid residue position 112;
(k) A at amino acid residue position 113;
(l) S at amino acid residue position 116;

(m) M or L at amino acid residue position 117;
(n) M or L at amino acid residue position 131;
(o) M at amino acid residue position 134;
(p) Q at amino acid residue position 135;
(q) A or V at amino acid residue position 137;
(r) C or G amino acid residue 138;
(s) I at amino acid residue position 139;
(t) F or Y at amino acid residue position 140;
(u) L at amino acid residue position 147;
(v) L at amino acid residue position 151;
(w) A at amino acid residue position 164;
(x) V, A or L at amino acid residue position 170;
(y) G, A or V at amino acid residue position 173;
(z) L at amino acid residue position 174; and,
(aa) N or K at amino acid residue position 177,
wherein the amino acid residue position corresponds to the equivalent position using the amino acid numbering of wild type TetR(B). In some examples the isolated SuR polynucleotides encode SuR polypeptides comprising at least 10%, 20%, 30%, 40%, 50%, 55%, 60%, 65%, 66%, 67%, 68%, 69%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, 99% or 100% of the amino acid residues are selected from the amino acid residues listed in (a)-(aa) above, wherein the amino acid residue position corresponds to the equivalent position using the amino acid numbering of wild type TetR (B). In some examples the wild type TetR(B) is SEQ ID NO: 1.

In some examples the isolated polynucleotides encode SuR polypeptides having at least about 50% 60%, 65%, 66%, 67%, 68%, 69%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98% or 99% sequence identity to the ligand binding domain shown as amino acid residues 53-207 of SEQ ID NO: 1, wherein the sequence identity is determined over the full length of the ligand binding domain using a global alignment method. In some examples the global alignment method is GAP, wherein the default parameters are for an amino acid sequence % identity and % similarity using GAP Weight of 8 and Length Weight of 2, and the BLOSUM62 scoring matrix.

In some examples the isolated polynucleotides encode SuR polypeptides having at least about 50% 60%, 65%, 66%, 67%, 68%, 69%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98% or 99% sequence identity to SEQ ID NO: 1, wherein the sequence identity is determined over the full length of the polypeptide using a global alignment method. In some examples the global alignment method is GAP, wherein the default parameters are for an amino acid sequence % identity and % similarity using GAP Weight of 8 and Length Weight of 2, and the BLOSUM62 scoring matrix.

In some examples the isolated polynucleotides include nucleic acid sequences that selectively hybridize under stringent hybridization conditions to a polynucleotide encoding a SuR polypeptide. Polynucleotides that selectively hybridize are polynucleotides which bind to a target sequence at a level of at least 2-fold over background as compared to hybridization to a non-target sequence. Stringent conditions are sequence-dependent and condition-dependent. Typical stringent conditions are those in which the salt concentration about 0.01 to 1.0 M at pH 7.0-8.3 at 30° C. for short probes (e.g., 10 to 50 nucleotides) or about 60° C. for long probes (e.g., greater than 50 nucleotides). Stringent conditions may include formamide or other destabilizing agents. Exemplary moderate stringency conditions include hybridization in 40 to 45% formamide, 1 M NaCl, 1% SDS at 37° C., and a wash in 0.5× to 1×SSC at 55 to 60° C. Exemplary high stringency conditions include hybridization in 50% formamide, 1 M NaCl, 1% SDS at 37° C., and a wash in 0.1×SSC at 60 to 65° C.

Specificity is impacted by post-hybridization wash conditions, typically via ionic strength and temperature. For DNA-DNA hybrids, the $T_m$ can be approximated from the equation of Meinkoth and Wahl, (1984) *Anal. Biochem.* 138:267-284: $T_m$=81.5° C.+16.6 (log M)+0.41 (% GC)−0.61 (% form)−500/L; where M is the molarity of monovalent cations, % GC is the percentage of guanosine and cytosine nucleotides in the DNA, % form is the percentage of formamide in the hybridization solution, and L is the length of the hybrid in base pairs. An extensive guide to the hybridization of nucleic acids is found in Tijssen, *Laboratory Techniques in Biochemistry and Molecular Biology—Hybridization with Nucleic Acid Probes*, Part I, Chapter 2 "Overview of principles of hybridization and the strategy of nucleic acid probe assays", Elsevier, N.Y. (1993); and *Current Protocols in Molecular Biology*, Chapter 2, Ausubel, et al., Eds., Greene Publishing and Wiley-Interscience, New York (1995). In some examples, the isolated polynucleotides encoding SuR polypeptides specifically hybridize to a polynucleotide of SEQ ID NO: 434-832, 1214-1221, 1234-1239, or 1244-1247 under moderately stringent conditions or under highly stringent conditions.

In some examples the isolated polynucleotides encode an SuR polypeptide comprising an amino acid sequence that can be optimally aligned with a polypeptide sequence of L7-1A04 (SEQ ID NO: 220) to generate a BLAST bit score of at least 200, 250, 275, 300, 325, 350, 375, 400, 425, 450, 475, 500, 525, 550, 575, 600, 625, 650, 675, 700, or 750, wherein the BLAST alignment used the BLOSUM62 matrix, a gap existence penalty of 11, and a gap extension penalty of 1. In some examples the isolated polynucleotides encode an SuR polypeptide comprising an amino acid sequence that can be optimally aligned with a polypeptide sequence of L7-1A04 (SEQ ID NO: 220) to generate a BLAST bit score of at least 374, wherein the BLAST alignment used the BLOSUM62 matrix, a gap existence penalty of 11, and a gap extension penalty of 1. In some examples the isolated polynucleotides encode SuR polypeptides comprising an amino acid sequence that can be optimally aligned with a polypeptide sequence of L7-1A04 (SEQ ID NO:220) to generate a percent sequence identity of at least 50% 60%, 65%, 66%, 67%, 68%, 69%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98% or 99% sequence identity, wherein the sequence identity is determined by BLAST alignment using the BLOSUM62 matrix, a gap existence penalty of 11, and a gap extension penalty of 1. In some examples the isolated polynucleotides encode SuR polypeptides comprising an amino acid sequence that can be optimally aligned with a polypeptide sequence of L7-1A04 (SEQ ID NO:220) to generate a percent sequence identity of at least 88% sequence identity, wherein the sequence identity is determined by BLAST alignment using the BLOSUM62 matrix, a gap existence penalty of 11, and a gap extension penalty of 1. In some examples the percent identity is determined using a global alignment method using the GAP algorithm with default parameters for an amino acid sequence % identity and % similarity using GAP Weight of 8 and Length Weight of 2, and the BLOSUM62 scoring matrix. In some examples the isolated polynucleotides encode SuR polypeptides comprising an amino acid sequence that can be optimally aligned with a polypeptide sequence of L7-1A04 (SEQ ID NO:220) to generate a BLAST similarity score of at least 400, 425, 450, 475, 500, 525, 550, 575, 600, 625, 650, 675, 600, 750, 800, 850, 900, 910, 920, 930, 940, 950, 960, 970, 980, 990, 1000, 1010, 1020, 1030, 1040, 1050, 1060, 1070, 1080, 1090, 1100, 1110, 1120, 1130, 1140, 1150, 1160, 1170, 1180, 1190, or 1200, wherein BLAST alignment used the BLOSUM62 matrix, a gap existence penalty of 11, and a gap extension penalty of 1. In some examples the isolated polynucleotides encode SuR polypeptides comprising an amino acid sequence that can be optimally aligned with a polypeptide sequence of L7-1A04 (SEQ ID NO:220) to generate a BLAST e-value score of at least e-60, e-70, e-80, e-85, e-90, e-95, e-100, e-105, e-106, e-107, e-108, e-109, e-110, e-111, e-112, e-113, e-114, e-115, e-116, e-117, e-118, e-119, e-120, or e-125, wherein BLAST alignment used the BLOSUM62 matrix, a gap existence penalty of 11, and a gap extension penalty of 1. In some examples isolated polynucleotide encodes a polypeptide selected from the group consisting of SEQ ID NO: 3-401, 1206-1213, 1228-1233, or 1240-1243. In some examples the isolated polynucleotides comprise a polynucleotide sequence of SEQ ID NO: 434-832, 1214-1221, 1234-1239, or 1244-1247, or the complementary polynucleotide thereof.

In some examples the isolated polynucleotides encode an SuR polypeptide comprising an amino acid sequence that can be optimally aligned with a polypeptide sequence of L1-22 (SEQ ID NO: 7) to generate a BLAST bit score of at least 200, 250, 275, 300, 325, 350, 375, 400, 425, 450, 475, 500, 525, 550, 575, 600, 625, 650, 675, 700, or 750, wherein the BLAST alignment used the BLOSUM62 matrix, a gap existence penalty of 11, and a gap extension penalty of 1. In some examples the isolated polynucleotides encode an SuR polypeptide comprising an amino acid sequence that can be optimally aligned with a polypeptide sequence of L1-22 (SEQ ID NO: 7) to generate a BLAST bit score of at least 387, wherein the BLAST alignment used the BLOSUM62 matrix, a gap existence penalty of 11, and a gap extension penalty of 1. In some examples the isolated polynucleotides encode SuR polypeptides comprising an amino acid sequence that can be optimally aligned with a polypeptide sequence of L1-22 (SEQ ID NO: 7) to generate a percent sequence identity of at least 50% 60%, 65%, 66%, 67%, 68%, 69%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98% or 99% sequence identity, wherein the sequence identity is determined by BLAST alignment using the BLOSUM62 matrix, a gap existence penalty of 11, and a gap extension penalty of 1. In some examples the isolated polynucleotides encode SuR polypeptides comprising an amino acid sequence that can be optimally aligned with a polypeptide sequence of L1-22 (SEQ ID NO: 7) to generate a percent sequence identity of at least 92% sequence identity, wherein the sequence identity is determined by BLAST alignment using the BLOSUM62 matrix, a gap existence penalty of 11, and a gap extension penalty of 1. In some examples the percent sequence identity is determined using a global alignment method using the GAP algorithm with default parameters for an amino acid sequence % identity and % similarity using GAP Weight of 8 and Length Weight of 2, and the BLOSUM62 scoring matrix. In some examples the isolated polynucleotides encode SuR polypeptides comprising an amino acid sequence that can be optimally aligned with a polypeptide sequence of L1-22 (SEQ ID NO: 7) to generate a BLAST similarity score of at least 400, 425, 450, 475, 500, 525, 550, 575, 600, 625, 650, 675, 600, 750, 800, 850, 900, 910, 920, 930, 940, 950, 960, 970, 980, 990, 1000, 1010, 1020, 1030, 1040, 1050, 1060, 1070, 1080, 1090, 1100, 1110, 1120, 1130, 1140, 1150, 1160, 1170, 1180, 1190, or 1200, wherein BLAST alignment used the BLOSUM62 matrix, a gap existence penalty of 11, and a gap extension penalty of 1. In some examples the isolated polynucleotides encode SuR polypeptides comprising an amino acid sequence that can be optimally aligned with a polypeptide sequence of L1-22 (SEQ ID NO: 7) to generate a BLAST e-value score of at least e-60, e-70, e-80, e-85, e-90, e-95, e-100, e-105, e-106, e-107, e-108, e-109, e-110, e-111, e-112, e-113, e-114, e-115, e-116, e-117, e-118, e-119, e-120, or e-125, wherein BLAST alignment used the BLOSUM62 matrix, a gap existence penalty of 11, and a gap extension penalty of 1. In some examples isolated polynucleotide encodes a polypeptide selected from the group consisting of SEQ ID NO: 3-401, 1206-1213, 1228-1233, or 1240-1243. In some examples the isolated polynucleotides comprise a polynucleotide sequence of SEQ ID NO: 434-832, 1214-1221, 1234-1239, or 1244-1247, or the complementary polynucleotide thereof.

In some examples the isolated polynucleotides encode an SuR polypeptide comprising an amino acid sequence that can be optimally aligned with a polypeptide sequence of L1-29 (SEQ ID NO: 10) to generate a BLAST bit score of at least 200, 250, 275, 300, 325, 350, 375, 400, 425, 450, 475, 500, 525, 550, 575, 600, 625, 650, 675, 700, or 750, wherein the BLAST alignment used the BLOSUM62 matrix, a gap existence penalty of 11, and a gap extension penalty of 1. In some examples the isolated polynucleotides encode an SuR polypeptide comprising an amino acid sequence that can be optimally aligned with a polypeptide sequence of L1-29 (SEQ ID NO: 10) to generate a BLAST bit score of at least 393, wherein the BLAST alignment used the BLOSUM62 matrix, a gap existence penalty of 11, and a gap extension penalty of 1. In some examples the isolated polynucleotides encode SuR polypeptides comprising an amino acid sequence that can be optimally aligned with a polypeptide sequence of L1-29 (SEQ ID NO: 10) to generate a percent sequence identity of at least 50% 60%, 65%, 66%, 67%, 68%, 69%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98% or 99% sequence identity, wherein the sequence identity is determined by BLAST alignment using the BLOSUM62 matrix, a gap existence penalty of 11, and a gap extension penalty of 1. In some examples the percent sequence identity is determined using a global alignment method using the GAP algorithm with default parameters for an amino acid sequence % identity and % similarity using GAP Weight of 8 and Length Weight of 2, and the BLOSUM62 scoring matrix. In some examples the isolated polynucleotides encode SuR polypeptides comprising an amino acid sequence that can be optimally aligned with a polypeptide sequence of L1-29 (SEQ ID NO: 10) to generate a BLAST similarity score of at least 400, 425, 450, 475, 500, 525, 550, 575, 600, 625, 650, 675, 700, 750, 800, 850, 900, 910, 920, 930, 940, 950, 960, 970, 980, 990, 1000, 1010, 1020, 1030, 1040, 1050, 1060, 1070, 1080, 1090, 1100, 1110, 1120, 1130, 1140, 1150, 1160, 1170, 1180, 1190, or 1200 wherein the BLAST alignment used the BLOSUM62 matrix, a gap existence penalty of 11, and a gap extension penalty of 1. In some examples the isolated polynucleotides encode SuR polypeptides comprising an amino acid sequence that can be optimally aligned with a polypeptide sequence of L1-29 (SEQ ID NO: 10) to generate a BLAST similarity score of at least 1006, wherein the BLAST alignment used the BLOSUM62 matrix, a gap existence penalty of 11, and a gap extension penalty of 1. In some examples the isolated polynucleotides encode SuR polypeptides comprising an amino acid sequence that can be optimally aligned with a polypeptide sequence of L1-29 (SEQ ID NO: 10) to generate a BLAST e-value score of at least e-60, e-70, e-75, e-80, e-85, e-90, e-95, e-100, e-105, e-106, e-107, e-108, e-109, e-110, e-111, e-112, e-113, e-114, e-115, e-116, e-117, e-118, e-119, e-120, or e-125, wherein the BLAST alignment used the BLOSUM62 matrix, a gap existence penalty of 11, and a gap extension penalty of 1. In some examples isolated polynucleotide encodes a polypeptide is selected from the group consisting of SEQ ID NO: 3-401, 1206-1213, 1228-1233, or 1240-1243. In some examples the isolated polynucleotides comprise a polynucleotide sequence of SEQ ID NO: 434-832, 1214-1221, 1234-1239, or 1244-1247, or the complementary polynucleotide thereof.

In some examples the isolated polynucleotides encode an SuR polypeptide comprising an amino acid sequence that can be optimally aligned with a polypeptide sequence of L1-02 (SEQ ID NO: 3) to generate a BLAST bit score of at least 200, 250, 275, 300, 325, 350, 375, 400, 425, 450, 475, 500, 525, 550, 575, 600, 625, 650, 675, 700, or 750, wherein the BLAST alignment used the BLOSUM62 matrix, a gap existence penalty of 11, and a gap extension penalty of 1. In some examples the isolated polynucleotides encode SuR polypeptides comprising an amino acid sequence that can be optimally aligned with a polypeptide sequence of L1-02 (SEQ ID NO: 3) to generate a percent sequence identity of at least 50% 60%, 65%, 66%, 67%, 68%, 69%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98% or 99% sequence identity, wherein the sequence identity is determined by BLAST alignment using the BLOSUM62 matrix, a gap existence penalty of 11, and a gap extension penalty of 1. In some examples the percent sequence identity is determined using a global alignment method using the GAP algorithm with default parameters for an amino acid sequence % identity and % similarity using GAP Weight of 8 and Length Weight of 2, and the BLOSUM62 scoring matrix. In some examples the isolated polynucleotides encode SuR polypeptides comprising an amino acid sequence that can be optimally aligned with a polypeptide sequence of L1-02 (SEQ ID NO: 3) to generate a BLAST similarity score of at least 400, 425, 450, 475, 500, 525, 550, 575, 600, 625, 650, 675, 700, 750, 800, 850, 900, 910, 920, 930, 940, 950, 960, 970, 980, 990, 1000, 1010, 1020, 1030, 1040, 1050, 1060, 1070, 1080, 1090, 1100, 1110, 1120, 1130, 1140, 1150, 1160, 1170, 1180, 1190, or 1200 wherein the BLAST alignment used the BLOSUM62 matrix, a gap existence penalty of 11, and a gap extension penalty of 1. In some examples the isolated polynucleotides encode SuR polypeptides comprising an amino acid sequence that can be optimally aligned with a polypeptide sequence of L1-02 (SEQ ID NO: 3) to generate a BLAST e-value score of at least e-60, e-70, e-75, e-80, e-85, e-90, e-95, e-100, e-105, e-106, e-107, e-108, e-109, e-110, e-111, e-112, e-113, e-114, e-115, e-116, e-117, e-118, e-119, e-120, or e-125, wherein the BLAST alignment used the BLOSUM62 matrix, a gap existence penalty of 11, and a gap extension penalty of 1. In some examples the isolated polynucleotides encode SuR polypeptides comprising an amino acid sequence that can be optimally aligned with a polypeptide sequence of L1-02 (SEQ ID NO: 3) to generate a BLAST e-value score of at least e-112, wherein the BLAST alignment used the BLOSUM62 matrix, a gap existence penalty of 11, and a gap extension penalty of 1. In some examples isolated polynucleotide encodes a polypeptide is selected from the group consisting of SEQ ID NO: 3-401, 1206-1213, 1228-1233, or 1240-1243. In some examples the isolated polynucleotides comprise a polynucle-otide sequence of SEQ ID NO: 434-832, 1214-1221, 1234-1239, or 1244-1247, or the complementary polynucleotide thereof.

In some examples the isolated polynucleotides encode an SuR polypeptide comprising an amino acid sequence that can be optimally aligned with a polypeptide sequence of L1-07 (SEQ ID NO: 4) to generate a BLAST bit score of at least 200, 250, 275, 300, 325, 350, 375, 400, 425, 450, 475, 500, 525, 550, 575, 600, 625, 650, 675, 700, or 750, wherein the BLAST alignment used the BLOSUM62 matrix, a gap existence penalty of 11, and a gap extension penalty of 1. In some examples the isolated polynucleotides encode an SuR polypeptide comprising an amino acid sequence that can be optimally aligned with a polypeptide sequence of L1-07 (SEQ ID NO: 4) to generate a BLAST bit score of at least 388, wherein the BLAST alignment used the BLOSUM62 matrix, a gap existence penalty of 11, and a gap extension penalty of 1. In some examples the isolated polynucleotides encode SuR polypeptides comprising an amino acid sequence that can be optimally aligned with a polypeptide sequence of L1-07 (SEQ ID NO: 4) to generate a percent sequence identity of at least 50% 60%, 65%, 66%, 67%, 68%, 69%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98% or 99% sequence identity, wherein the sequence identity is determined by BLAST alignment using the BLOSUM62 matrix, a gap existence penalty of 11, and a gap extension penalty of 1. In some examples the isolated polynucleotides encode SuR polypeptides comprising an amino acid sequence that can be optimally aligned with a polypeptide sequence of L1-07 (SEQ ID NO: 4) to generate a percent sequence identity of at least 93% sequence identity, wherein the sequence identity is determined by BLAST alignment using the BLOSUM62 matrix, a gap existence penalty of 11, and a gap extension penalty of 1. In some examples the percent sequence identity is determined using a global alignment method using the GAP algorithm with default parameters for an amino acid sequence % identity and % similarity using GAP Weight of 8 and Length Weight of 2, and the BLOSUM62 scoring matrix. In some examples the isolated polynucleotides encode SuR polypeptides comprising an amino acid sequence that can be optimally aligned with a polypeptide sequence of L1-07 (SEQ ID NO: 4) to generate a BLAST similarity score of at least 400, 425, 450, 475, 500, 525, 550, 575, 600, 625, 650, 675, 700, 750, 800, 850, 900, 910, 920, 930, 940, 950, 960, 970, 980, 990, 1000, 1010, 1020, 1030, 1040, 1050, 1060, 1070, 1080, 1090, 1100, 1110, 1120, 1130, 1140, 1150, 1160, 1170, 1180, 1190, or 1200, wherein the BLAST alignment used the BLOSUM62 matrix, a gap existence penalty of 11, and a gap extension penalty of 1. In some examples the isolated polynucleotides encode SuR polypeptides comprising an amino acid sequence that can be optimally aligned with a polypeptide sequence of L1-07 (SEQ ID NO: 4) to generate a BLAST similarity score of at least 996 wherein the BLAST alignment used the BLOSUM62 matrix, a gap existence penalty of 11, and a gap extension penalty of 1. In some examples the isolated polynucleotides encode SuR polypeptides comprising an amino acid sequence that can be optimally aligned with a polypeptide sequence of L1-07 (SEQ ID NO: 4) to generate a BLAST e-value score of at least e-60, e-70, e-75, e-80, e-85, e-90, e-95, e-100, e-105, e-106, e-107, e-108, e-109, e-110, e-111, e-112, e-113, e-114, e-115, e-116, e-117, e-118, e-119, e-120, or e-125, wherein the BLAST alignment used the BLOSUM62 matrix, a gap existence penalty of 11, and a gap extension penalty of 1. In some examples the isolated polynucleotides encode SuR polypeptides comprising an amino acid sequence that can be optimally aligned with a polypeptide sequence of L1-07 (SEQ ID NO: 4) to generate a BLAST e-value score of at least e-111, wherein the BLAST alignment used the BLOSUM62 matrix, a gap existence penalty of 11, and a gap extension penalty of 1. In some examples isolated polynucleotide encodes a polypeptide is selected from the group consisting of SEQ ID NO: 3-401, 1206-1213, 1228-1233, or 1240-1243. In some examples the isolated polynucleotides comprise a polynucleotide sequence of SEQ ID NO: 434-832, 1214-1221, 1234-1239, or 1244-1247, or the complementary polynucleotide thereof.

In some examples the isolated polynucleotides encode an SuR polypeptide comprising an amino acid sequence that can be optimally aligned with a polypeptide sequence of L1-20 (SEQ ID NO: 6) to generate a BLAST bit score of at least 200, 250, 275, 300, 325, 350, 375, 400, 425, 450, 475, 500, 525, 550, 575, 600, 625, 650, 675, 700, or 750, wherein the BLAST alignment used the BLOSUM62 matrix, a gap existence penalty of 11, and a gap extension penalty of 1. In some examples the isolated polynucleotides encode SuR polypeptides comprising an amino acid sequence that can be optimally aligned with a polypeptide sequence of L1-20 (SEQ ID NO: 6) to generate a percent sequence identity of at least 50% 60%, 65%, 66%, 67%, 68%, 69%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98% or 99% sequence identity, wherein the sequence identity is determined by BLAST alignment using the BLOSUM62 matrix, a gap existence penalty of 11, and a gap extension penalty of 1. In some examples the isolated polynucleotides encode SuR polypeptides comprising an amino acid sequence that can be optimally aligned with a polypeptide sequence of L1-20 (SEQ ID NO: 6) to generate a percent sequence identity of at least 93% sequence identity, wherein the sequence identity is determined by BLAST alignment using the BLOSUM62 matrix, a gap existence penalty of 11, and a gap extension penalty of 1. In some examples the percent sequence identity is determined using a global alignment method using the GAP algorithm with default parameters for an amino acid sequence % identity and % similarity using GAP Weight of 8 and Length Weight of 2, and the BLOSUM62 scoring matrix. In some examples the isolated polynucleotides encode SuR polypeptides comprising an amino acid sequence that can be optimally aligned with a polypeptide sequence of L1-20 (SEQ ID NO: 6) to generate a BLAST similarity score of at least 400, 425, 450, 475, 500, 525, 550, 575, 600, 625, 650, 675, 700, 750, 800, 850, 900, 910, 920, 930, 940, 950, 960, 970, 980, 990, 1000, 1010, 1020, 1030, 1040, 1050, 1060, 1070, 1080, 1090, 1100, 1110, 1120, 1130, 1140, 1150, 1160, 1170, 1180, 1190, or 1200, wherein the BLAST alignment used the BLOSUM62 matrix, a gap existence penalty of 11, and a gap extension penalty of 1. In some examples the isolated polynucleotides encode SuR polypeptides comprising an amino acid sequence that can be optimally aligned with a polypeptide sequence of L1-20 (SEQ ID NO: 6) to generate a BLAST e-value score of at least e-60, e-70, e-75, e-80, e-85, e-90, e-95, e-100, e-105, e-106, e-107, e-108, e-109, e-110, e-111, e-112, e-113, e-114, e-115, e-116, e-117, e-118, e-119, e-120, or e-125, wherein the BLAST alignment used the BLOSUM62 matrix, a gap existence penalty of 11, and a gap extension penalty of 1. In some examples the isolated polynucleotides encode SuR polypeptides comprising an amino acid sequence that can be optimally aligned with a polypeptide sequence of L1-20 (SEQ ID NO: 6) to generate a BLAST e-value score of at least e-111, wherein the BLAST alignment used the BLOSUM62 matrix, a gap existence penalty of 11, and a gap extension penalty of 1. In some examples isolated polynucleotide encodes a polypeptide is selected from the group consisting of SEQ ID NO: 3-401, 1206-1213, 1228-1233, or 1240-1243. In some examples the isolated polynucleotides comprise a polynucleotide sequence of SEQ ID NO: 434-832, 1214-1221, 1234-1239, or 1244-1247, or the complementary polynucleotide thereof.

In some examples the isolated polynucleotides encode an SuR polypeptide comprising an amino acid sequence that can be optimally aligned with a polypeptide sequence of L1-44 (SEQ ID NO: 13) to generate a BLAST bit score of at least 200, 250, 275, 300, 325, 350, 375, 400, 425, 450, 475, 500, 525, 550, 575, 600, 625, 650, 675, 700, or 750, wherein the BLAST alignment used the BLOSUM62 matrix, a gap existence penalty of 11, and a gap extension penalty of 1. In some examples the isolated polynucleotides encode SuR polypeptides comprising an amino acid sequence that can be optimally aligned with a polypeptide sequence of L1-44 (SEQ ID NO: 13) to generate a percent sequence identity of at least 50% 60%, 65%, 66%, 67%, 68%, 69%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93 %, 94%, 95%, 96%, 97%, 98% or 99% sequence identity, wherein the sequence identity is determined by BLAST alignment using the BLOSUM62 matrix, a gap existence penalty of 11, and a gap extension penalty of 1. In some examples the isolated polynucleotides encode SuR polypeptides comprising an amino acid sequence that can be optimally aligned with a polypeptide sequence of L1-44 (SEQ ID NO: 13) to generate a percent sequence identity of at least 93% sequence identity, wherein the sequence identity is determined by BLAST alignment using the BLOSUM62 matrix, a gap existence penalty of 11, and a gap extension penalty of 1. In some examples the percent sequence identity is determined using a global alignment method using the GAP algorithm with default parameters for an amino acid sequence % identity and % similarity using GAP Weight of 8 and Length Weight of 2, and the BLOSUM62 scoring matrix. In some examples the isolated polynucleotides encode SuR polypeptides comprising an amino acid sequence that can be optimally aligned with a polypeptide sequence of L1-44 (SEQ ID NO: 13) to generate a BLAST similarity score of at least 400, 425, 450, 475, 500, 525, 550, 575, 600, 625, 650, 675, 700, 750, 800, 850, 900, 910, 920, 930, 940, 950, 960, 970, 980, 990, 1000, 1010, 1020, 1030, 1040, 1050, 1060, 1070, 1080, 1090, 1100, 1110, 1120, 1130, 1140, 1150, 1160, 1170, 1180, 1190, or 1200, wherein the BLAST alignment used the BLOSUM62 matrix, a gap existence penalty of 11, and a gap extension penalty of 1. In some examples the isolated polynucleotides encode SuR polypeptides comprising an amino acid sequence that can be optimally aligned with a polypeptide sequence of L1-44 (SEQ ID NO: 13) to generate a BLAST e-value score of at least e-60, e-70, e-75, e-80, e-85, e-90, e-95, e-100, e-105, e-106, e-107, e-108, e-109, e-110, e-111, e-112, e-113, e-114, e-115, e-116, e-117, e-118, e-119, e-120, or e-125, wherein the BLAST alignment used the BLOSUM62 matrix, a gap existence penalty of 11, and a gap extension penalty of 1. In some examples isolated polynucleotide encodes a polypeptide is selected from the group consisting of SEQ ID NO: 3-401, 1206-1213, 1228-1233, or 1240-1243. In some examples the isolated polynucleotides comprise a polynucleotide sequence of SEQ ID NO: 434-832, 1214-1221, 1234-1239, or 1244-1247, or the complementary polynucleotide thereof.

In some examples the isolated polynucleotides encode an SuR polypeptide comprising an amino acid sequence that can be optimally aligned with a polypeptide sequence of L6-3A09 (SEQ ID NO: 1228) to generate a BLAST bit score of at least 200, 250, 275, 300, 325, 350, 375, 400, 425, 450, 475, 500, 525, 550, 575, 600, 625, 650, 675, 700, or 750, wherein the BLAST alignment used the BLOSUM62 matrix, a gap existence penalty of 11, and a gap extension penalty of 1. In some examples the isolated polynucleotides encode an SuR polypeptide comprising an amino acid sequence that can be optimally aligned with a polypeptide sequence of L6-3A09 (SEQ ID NO: 1228) to generate a BLAST bit score of at least 381, wherein the BLAST alignment used the BLOSUM62 matrix, a gap existence penalty of 11, and a gap extension penalty of 1. In some examples the isolated polynucleotides encode SuR polypeptides comprising an amino acid sequence that can be optimally aligned with a polypeptide sequence of L6-3A09 (SEQ ID NO: 1228) to generate a percent sequence identity of at least 50% 60%, 65%, 66%, 67%, 68%, 69%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98% or 99% sequence identity, wherein the sequence identity is determined by BLAST alignment using the BLOSUM62 matrix, a gap existence penalty of 11, and a gap extension penalty of 1. In some examples the percent sequence identity is determined using a global alignment method using the GAP algorithm with default parameters for an amino acid sequence % identity and % similarity using GAP Weight of 8 and Length Weight of 2, and the BLOSUM62 scoring matrix. In some examples the isolated polynucleotides encode SuR polypeptides comprising an amino acid sequence that can be optimally aligned with a polypeptide sequence of L6-3A09 (SEQ ID NO: 1228) to generate a BLAST similarity score of at least 400, 425, 450, 475, 500, 525, 550, 575, 600, 625, 650, 675, 700, 750, 800, 850, 900, 910, 920, 930, 940, 950, 960, 970, 980, 990, 1000, 1010, 1020, 1030, 1040, 1050, 1060, 1070, 1080, 1090, 1100, 1110, 1120, 1130, 1140, 1150, 1160, 1170, 1180, 1190, or 1200, wherein the BLAST alignment used the BLOSUM62 matrix, a gap existence penalty of 11, and a gap extension penalty of 1. In some examples the isolated polynucleotides encode SuR polypeptides comprising an amino acid sequence that can be optimally aligned with a polypeptide sequence of L6-3A09 (SEQ ID NO: 1228) to generate a BLAST similarity score of at least 978, wherein the BLAST alignment used the BLOSUM62 matrix, a gap existence penalty of 11, and a gap extension penalty of 1. In some examples the isolated polynucleotides encode SuR polypeptides comprising an amino acid sequence that can be optimally aligned with a polypeptide sequence of L6-3A09 (SEQ ID NO: 1228) to generate a BLAST e-value score of at least e-60, e-70, e-75, e-80, e-85, e-90, e-95, e-100, e-105, e-106, e-107, e-108, e-109, e-110, e-111, e-112, e-113, e-114, e-115, e-116, e-117, e-118, e-119, e-120, or e-125, wherein the BLAST alignment used the BLOSUM62 matrix, a gap existence penalty of 11, and a gap extension penalty of 1. In some examples the isolated polynucleotides encode SuR polypeptides comprising an amino acid sequence that can be optimally aligned with a polypeptide sequence of L6-3A09 (SEQ ID NO: 1228) to generate a BLAST e-value score of at least e-108, wherein the BLAST alignment used the BLOSUM62 matrix, a gap existence penalty of 11, and a gap extension penalty of 1. In some examples isolated polynucleotide encodes a polypeptide is selected from the group consisting of SEQ ID NO: 3-401, 1206-1213, 1228-1233, or 1240-1243. In some examples the isolated polynucleotides comprise a polynucleotide sequence of SEQ ID NO: 434-832, 1214-1221, 1234-1239, or 1244-1247, or the complementary polynucleotide thereof.

In some examples the isolated polynucleotides encode an SuR polypeptide comprising an amino acid sequence that can be optimally aligned with a polypeptide sequence of L6-3H02 (SEQ ID NO: 94) to generate a BLAST bit score of at least 200, 250, 275, 300, 325, 350, 375, 400, 425, 450, 475, 500, 525, 550, 575, 600, 625, 650, 675, 700, or 750, wherein the BLAST alignment used the BLOSUM62 matrix, a gap existence penalty of 11, and a gap extension penalty of 1. In some examples the isolated polynucleotides encode SuR polypeptides comprising an amino acid sequence that can be optimally aligned with a polypeptide sequence of L6-3H02 (SEQ ID NO: 94) to generate a percent sequence identity of at least 50% 60%, 65%, 66%, 67%, 68%, 69%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98% or 99% sequence identity, wherein the sequence identity is determined by BLAST alignment using the BLOSUM62 matrix, a gap existence penalty of 11, and a gap extension penalty of 1. In some examples the isolated polynucleotides encode SuR polypeptides comprising an amino acid sequence that can be optimally aligned with a polypeptide sequence of L6-3H02 (SEQ ID NO: 94) to generate a percent sequence identity of at least 90% sequence identity, wherein the sequence identity is determined by BLAST alignment using the BLOSUM62 matrix, a gap existence penalty of 11, and a gap extension penalty of 1. In some examples the percent sequence identity is determined using a global alignment method using the GAP algorithm with default parameters for an amino acid sequence % identity and % similarity using GAP Weight of 8 and Length Weight of 2, and the BLOSUM62 scoring matrix. In some examples the isolated polynucleotides encode SuR polypeptides comprising an amino acid sequence that can be optimally aligned with a polypeptide sequence of L6-3H02 (SEQ ID NO: 94) to generate a BLAST similarity score of at least 400, 425, 450, 475, 500, 525, 550, 575, 600, 625, 650, 675, 700, 750, 800, 850, 900, 910, 920, 930, 940, 950, 960, 970, 980, 990, 1000, 1010, 1020, 1030, 1040, 1050, 1060, 1070, 1080, 1090, 1100, 1110, 1120, 1130, 1140, 1150, 1160, 1170, 1180, 1190, or 1200, wherein the BLAST alignment used the BLOSUM62 matrix, a gap existence penalty of 11, and a gap extension penalty of 1. In some examples the isolated polynucleotides encode SuR polypeptides comprising an amino acid sequence that can be optimally aligned with a polypeptide sequence of L6-3H02 (SEQ ID NO: 94) to generate a BLAST e-value score of at least e-60, e-70, e-75, e-80, e-85, e-90, e-95, e-100, e-105, e-106, e-107, e-108, e-109, e-110, e-111, e-112, e-113, e-114, e-115, e-116, e-117, e-118, e-119, e-120, or e-125, wherein the BLAST alignment used the BLOSUM62 matrix, a gap existence penalty of 11, and a gap extension penalty of 1. In some examples isolated polynucleotide encodes a polypeptide is selected from the group consisting of SEQ ID NO: 3-401, 1206-1213, 1228-1233, or 1240-1243. In some examples the isolated polynucleotides comprise a polynucleotide sequence of SEQ ID NO: 434-832, 1214-1221, 1234-1239, or 1244-1247, or the complementary polynucleotide thereof.

In some examples the isolated polynucleotides encode an SuR polypeptide comprising an amino acid sequence that can be optimally aligned with a polypeptide sequence of L7-4E03 (SEQ ID NO: 1229) to generate a BLAST bit score of at least 200, 250, 275, 300, 325, 350, 375, 400, 425, 450, 475, 500, 525, 550, 575, 600, 625, 650, 675, 700, or 750, wherein the BLAST alignment used the BLOSUM62 matrix, a gap existence penalty of 11, and a gap extension penalty of 1. In some examples the isolated polynucleotides encode an SuR polypeptide comprising an amino acid sequence that can be optimally aligned with a polypeptide sequence of L7-4E03 (SEQ ID NO: 1229) to generate a BLAST bit score of at least 368, wherein the BLAST alignment used the BLOSUM62 matrix, a gap existence penalty of 11, and a gap extension penalty of 1. In some examples the isolated polynucleotides encode SuR polypeptides comprising an amino acid sequence that can be optimally aligned with a polypeptide sequence of L7-4E03 (SEQ ID NO: 1229) to generate a percent sequence identity of at least 50% 60%, 65%, 66%, 67%, 68%, 69%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98% or 99% sequence identity, wherein the sequence identity is determined by BLAST alignment using the BLOSUM62 matrix, a gap existence penalty of 11, and a gap extension penalty of 1. In some examples the percent sequence identity is determined using a global alignment method using the GAP algorithm with default parameters for an amino acid sequence % identity and % similarity using GAP Weight of 8 and Length Weight of 2, and the BLOSUM62 scoring matrix. In some examples the isolated polynucleotides encode SuR polypeptides comprising an amino acid sequence that can be optimally aligned with a polypeptide sequence of L7-4E03 (SEQ ID NO: 1229) to generate a BLAST similarity score of at least 400, 425, 450, 475, 500, 525, 550, 575, 600, 625, 650, 675, 700, 750, 800, 850, 900, 910, 920, 930, 940, 950, 960, 970, 980, 990, 1000, 1010, 1020, 1030, 1040, 1050, 1060, 1070, 1080, 1090, 1100, 1110, 1120, 1130, 1140, 1150, 1160, 1170, 1180, 1190, or 1200, wherein the BLAST alignment used the BLOSUM62 matrix, a gap existence penalty of 11, and a gap extension penalty of 1. In some examples the isolated polynucleotides encode SuR polypeptides comprising an amino acid sequence that can be optimally aligned with a polypeptide sequence of L7-4E03 (SEQ ID NO: 1229) to generate a BLAST similarity score of at least 945, wherein the BLAST alignment used the BLOSUM62 matrix, a gap existence penalty of 11, and a gap extension penalty of 1. In some examples the isolated polynucleotides encode SuR polypeptides comprising an amino acid sequence that can be optimally aligned with a polypeptide sequence of L7-4E03 (SEQ ID NO: 1229) to generate a BLAST e-value score of at least e-60, e-70, e-75, e-80, e-85, e-90, e-95, e-100, e-105, e-106, e-107, e-108, e-109, e-110, e-111, e-112, e-113, e-114, e-115, e-116, e-117, e-118, e-119, e-120, or e-125, wherein the BLAST alignment used the BLOSUM62 matrix, a gap existence penalty of 11, and a gap extension penalty of 1. In some examples the isolated polynucleotides encode SuR polypeptides comprising an amino acid sequence that can be optimally aligned with a polypeptide sequence of L7-4E03 (SEQ ID NO: 1229) to generate a BLAST e-value score of at least e-105, wherein the BLAST alignment used the BLOSUM62 matrix, a gap existence penalty of 11, and a gap extension penalty of 1. In some examples isolated polynucleotide encodes a polypeptide is selected from the group consisting of SEQ ID NO: 3-401, 1206-1213, 1228-1233, or 1240-1243. In some examples the isolated polynucleotides comprise a polynucleotide sequence of SEQ ID NO: 434-832, 1214-1221, 1234-1239, or 1244-1247, or the complementary polynucleotide thereof.

In some examples the isolated polynucleotides encode an SuR polypeptide comprising an amino acid sequence that can be optimally aligned with a polypeptide sequence of L10-84 (B12) (SEQ ID NO: 1230) to generate a BLAST bit score of at least 200, 250, 275, 300, 325, 350, 375, 400, 425, 450, 475, 500, 525, 550, 575, 600, 625, 650, 675, 700, or 750, wherein the BLAST alignment used the BLOSUM62 matrix, a gap existence penalty of 11, and a gap extension penalty of 1. In some examples the isolated polynucleotides encode SuR polypeptides comprising an amino acid sequence that can be optimally aligned with a polypeptide sequence of L10-84 (B12) (SEQ ID NO: 1230) to generate a percent sequence identity of at least 50% 60%, 65%, 66%, 67%, 68%, 69%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98% or 99% sequence identity, wherein the sequence identity is determined by BLAST alignment using the BLOSUM62 matrix, a gap existence penalty of 11, and a gap extension penalty of 1. In some examples the isolated polynucleotides encode SuR polypeptides comprising an amino acid sequence that can be optimally aligned with a polypeptide sequence of L10-84 (B12) (SEQ ID NO: 1230) to generate a percent sequence identity of at least 86% sequence identity, wherein the sequence identity is determined by BLAST alignment using the BLOSUM62 matrix, a gap existence penalty of 11, and a gap extension penalty of 1. In some examples the percent sequence identity is determined using a global alignment method using the GAP algorithm with default parameters for an amino acid sequence % identity and % similarity using GAP Weight of 8 and Length Weight of 2, and the BLOSUM62 scoring matrix. In some examples the isolated polynucleotides encode SuR polypeptides comprising an amino acid sequence that can be optimally aligned with a polypeptide sequence of L10-84(B12) (SEQ ID NO: 1230) to generate a BLAST similarity score of at least 400, 425, 450, 475, 500, 525, 550, 575, 600, 625, 650, 675, 700, 750, 800, 850, 900, 910, 920, 930, 940, 950, 960, 970, 980, 990, 1000, 1010, 1020, 1030, 1040, 1050, 1060, 1070, 1080, 1090, 1100, 1110, 1120, 1130, 1140, 1150, 1160, 1170, 1180, 1190, or 1200, wherein the BLAST alignment used the BLOSUM62 matrix, a gap existence penalty of 11, and a gap extension penalty of 1. In some examples the isolated polynucleotides encode SuR polypeptides comprising an amino acid sequence that can be optimally aligned with a polypeptide sequence of L10-84 (B12) (SEQ ID NO: 1230) to generate a BLAST e-value score of at least e-60, e-70, e-75, e-80, e-85, e-90, e-95, e-100, e-105, e-106, e-107, e-108, e-109, e-110, e-111, e-112, e-113, e-114, e-115, e-116, e-117, e-118, e-119, e-120, or e-125, wherein the BLAST alignment used the BLOSUM62 matrix, a gap existence penalty of 11, and a gap extension penalty of 1. In some examples isolated polynucleotide encodes a polypeptide is selected from the group consisting of SEQ ID NO: 3-401, 1206-1213, 1228-1233, or 1240-1243. In some examples the isolated polynucleotides comprise a polynucleotide sequence of SEQ ID NO: 434-832, 1214-1221, 1234-1239, or 1244-1247, or the complementary polynucleotide thereof.

In some examples the isolated polynucleotides encode an SuR polypeptide comprising an amino acid sequence that can be optimally aligned with a polypeptide sequence of L13-46 (SEQ ID NO: 1231) to generate a BLAST bit score of at least 200, 250, 275, 300, 325, 350, 375, 400, 425, 450, 475, 500, 525, 550, 575, 600, 625, 650, 675, 700, or 750, wherein the BLAST alignment used the BLOSUM62 matrix, a gap existence penalty of 11, and a gap extension penalty of 1. In some examples the isolated polynucleotides encode an SuR polypeptide comprising an amino acid sequence that can be optimally aligned with a polypeptide sequence of L13-46 (SEQ ID NO: 1231) to generate a BLAST bit score of at least 320, wherein the BLAST alignment used the BLOSUM62 matrix, a gap existence penalty of 11, and a gap extension penalty of 1. In some examples the isolated polynucleotides encode SuR polypeptides comprising an amino acid sequence that can be optimally aligned with a polypeptide sequence of L13-46 (SEQ ID NO: 1231) to generate a percent sequence identity of at least 50% 60%, 65%, 66%, 67%, 68%, 69%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98% or 99% sequence identity, wherein the sequence identity is determined by BLAST alignment using the BLOSUM62 matrix, a gap existence penalty of 11, and a gap extension penalty of 1. In some examples the isolated polynucleotides encode SuR polypeptides comprising an amino acid sequence that can be optimally aligned with a polypeptide sequence of L13-46 (SEQ ID NO: 1231) to generate a percent sequence identity of at least 86% sequence identity, wherein the sequence identity is determined by BLAST alignment using the BLOSUM62 matrix, a gap existence penalty of 11, and a gap extension penalty of 1. In some examples the percent sequence identity is determined using a global alignment method using the GAP algorithm with default parameters for an amino acid sequence % identity and % similarity using GAP Weight of 8 and Length Weight of 2, and the BLOSUM62 scoring matrix. In some examples the isolated polynucleotides encode SuR polypeptides comprising an amino acid sequence that can be optimally aligned with a polypeptide sequence of L13-46 (SEQ ID NO: 1231) to generate a BLAST similarity score of at least 400, 425, 450, 475, 500, 525, 550, 575, 600, 625, 650, 675, 700, 750, 800, 850, 900, 910, 920, 930, 940, 950, 960, 970, 980, 990, 1000, 1010, 1020, 1030, 1040, 1050, 1060, 1070, 1080, 1090, 1100, 1110, 1120, 1130, 1140, 1150, 1160, 1170, 1180, 1190, or 1200, wherein the BLAST alignment used the BLOSUM62 matrix, a gap existence penalty of 11, and a gap extension penalty of 1. In some examples the isolated polynucleotides encode SuR polypeptides comprising an amino acid sequence that can be optimally aligned with a polypeptide sequence of L13-46 (SEQ ID NO: 1231) to generate a BLAST similarity score of at least 819, wherein the BLAST alignment used the BLOSUM62 matrix, a gap existence penalty of 11, and a gap extension penalty of 1. In some examples the isolated polynucleotides encode SuR polypeptides comprising an amino acid sequence that can be optimally aligned with a polypeptide sequence of L13-46 (SEQ ID NO: 1231) to generate a BLAST e-value score of at least e-60, e-70, e-75, e-80, e-85, e-90, e-95, e-100, e-105, e-106, e-107, e-108, e-109, e-110, e-111, e-112, e-113, e-114, e-115, e-116, e-117, e-118, e-119, e-120, or e-125, wherein the BLAST alignment used the BLOSUM62 matrix, a gap existence penalty of 11, and a gap extension penalty of 1. In some examples the isolated polynucleotides encode SuR polypeptides comprising an amino acid sequence that can be optimally aligned with a polypeptide sequence of L13-46 (SEQ ID NO: 1231) to generate a BLAST e-value score of at least e-90, wherein the BLAST alignment used the BLOSUM62 matrix, a gap existence penalty of 11, and a gap extension penalty of 1. In some examples isolated polynucleotide encodes a polypeptide is selected from the group consisting of SEQ ID NO: 3-401, 1206-1213, 1228-1233, or 1240-1243. In some examples the isolated polynucleotides comprise a polynucleotide sequence of SEQ ID NO: 434-832, 1214-1221, 1234-1239, or 1244-1247, or the complementary polynucleotide thereof.

In some examples the isolated polynucleotides encode an SuR polypeptide comprising a ligand binding domain from a polypeptide selected from the group consisting of SEQ ID NO: 3-401, 1206-1213, 1228-1233, or 1240-1243. In some examples the isolated polynucleotides encode SuR polypeptides comprising an amino acid sequence selected from the group consisting of SEQ ID NO: 3-401, 1206-1213, 1228-1233, or 1240-1243. In some examples the encoded SuR polypeptide is selected from the group consisting of SEQ ID NO: 3-401, 1206-1213, 1228-1233, or 1240-1243, and the sulfonylurea compound is selected from the group consisting of chlorsulfuron, ethametsulfuron-methyl, metsulfuron-methyl, sulfometuron-methyl, and thifensulfuron-methyl. In some examples the isolated polynucleotides comprise a polynucleotide sequence of SEQ ID NO: 434-832, 1214-1221, 1234-1239, or 1244-1247, or the complementary polynucleotide thereof.

In some examples the isolated SuR polynucleotide encodes an SuR polypeptide having an equilibrium binding constant for a sulfonylurea compound greater than 0.1 nM and less than 10 µM. In some examples the encoded SuR polypeptide has an equilibrium binding constant for a sulfonylurea compound of at least 0.1 nM, 0.5nM, 1 nM, 10 nM, 50 nM, 100 nM, 250 nM, 500 nM, 750 nM, 1 µM, 5 µM, 7 µM but less than 10 µM. In some examples the encoded SuR polypeptide has an equilibrium binding constant for a sulfonylurea compound of at least 0.1 nM, 0.5nM, 1 nM, 10 nM, 50 nM, 100 nM, 250 nM, 500 nM, 750 nM but less than 1 µM. In some examples the encoded SuR polypeptide has an equilibrium binding constant for a sulfonylurea compound greater than 0 nM, but less than 0.1 nM, 0.5 nM, 1 nM, 10 nM, 50 nM, 100 nM, 250 nM, 500 nM, 750 nM, 1 µM, 5 µM, 7 µM, or 10 µM. In some examples the sulfonylurea compound is a chlorsulfuron, an ethametsulfuron, a metsulfuron, a sulfometuron, and/or a thifensulfuron compound.

In some examples the isolated SuR polynucleotide encodes an SuR polypeptide having an equilibrium binding constant for an operator sequence greater than 0.1 nM and less than 10 µM. In some examples the encoded SuR polypeptide has an equilibrium binding constant for an operator sequence of at least 0.1 nM, 0.5 nM, 1 nM, 10 nM, 50 nM, 100 nM, 250 nM, 500 nM, 750 nM, 1 µM, 5 µM, 7 µM but less than 10 µM. In some examples the encoded SuR polypeptide has an equilibrium binding constant for an operator sequence of at least 0.1 nM, 0.5nM, 1 nM, 10 nM, 50 nM, 100 nM, 250 nM, 500 nM, 750 nM but less than 1 µM. In some examples the encoded SuR polypeptide has an equilibrium binding constant for an operator sequence greater than 0 nM, but less than 0.1 nM, 0.5nM, 1 nM, 10 nM, 50 nM, 100 nM, 250 nM, 500 nM, 750 nM, 1 µM, 5 µM, 7 µM or 10 µM. In some examples the operator sequence is a Tet operator sequence. In some examples the Tet operator sequence is a TetR(A) operator sequence, a TetR(B) operator sequence, a TetR(D) operator sequence, TetR(E) operator sequence, a TetR(H) operator sequence or a functional derivative thereof.

In some examples the isolated polynucleotides encoding SuR polypeptides comprise codon composition profiles representative of codon preferences for particular host cells, or host cell organelles. In some examples the isolated polynucleotides comprise prokaryote preferred codons. In some examples the isolated polynucleotides comprise bacteria preferred codons. In some examples the bacteria is *E. coli* or *Agrobacterium*. In some examples the isolated polynucleotides comprise plastid preferred codons. In some examples the isolated polynucleotides comprise eukaryote preferred codons. In some examples the isolated polynucleotides comprise nuclear preferred codons. In some examples the isolated polynucleotides comprise plant preferred codons. In some examples the isolated polynucleotides comprise monocotyledonous plant preferred codons. In some examples the isolated polynucleotides comprise corn, rice, sorghum, barley, wheat, rye, switch grass, turf grass and/or oat preferred codons. In some examples the isolated polynucleotides comprise dicotyledonous plant preferred codons. In some examples the isolated polynucleotides comprise soybean, sunflower, safflower, *Brassica*, alfalfa, *Arabidopsis*, tobacco and/or cotton preferred codons. In some examples the isolated polynucleotides comprise yeast preferred codons. In some examples the isolated polynucleotides comprise mammalian preferred codons. In some examples the isolated polynucleotides comprise insect preferred codons.

Compositions also include isolated polynucleotides fully complementary to a polynucleotide encoding an SuR polypeptide, expression cassettes, replicons, vectors, T-DNAs, DNA libraries, host cells, tissues and/or organisms comprising the polynucleotides encoding the SuR polypeptides and/or complements or derivatives thereof. In some examples a DNA library comprising a population of polynucleotides which encode a population of SuR polypeptide variants is provided. In some examples the polynucleotide is stably incorporated into a genome of the host cell, tissue and/or organism. In some examples the host cell is a prokaryote, including E. coli and Agrobacterium strains. In some examples the host is a eukaryote, including for example yeast, insects, plants and mammals.

Methods using the compositions are further provided. In one example methods of regulating transcription of a polynucleotide of interest in a host cell are provided, the methods comprising: providing a cell comprising the polynucleotide of interest operably linked to a promoter comprising at least one tetracycline operator sequence; providing an SuR polypeptide and, providing a sulfonylurea compound, thereby regulating transcription of the polynucleotide of interest. Any host cell can be used, including for example prokaryotic cells such as bacteria, and eukaryotic cells, including yeast, plant, insect, and mammalian cells. In some examples providing the SuR polypeptide comprises contacting the cell with an expression cassette comprising a promoter functional in the cell operably linked to a polynucleotide that encodes the SuR polypeptide.

Methods for generating and selecting diversified libraries to produce additional SuR polynucleotides, including polynucleotides encoding SuR polypeptides with improved and/or enhanced characteristics, e.g., altered binding constants for sulfonylurea compounds and/or the target DNA operator sequence and/or increased stability, all based upon selection of a polynucleotide constituent of the library for the new or improved activities are also provided. In some examples at least one library or population of oligonucleotides designed to introduce sequence modifications and/or diversity to a wild type or modified TetR ligand binding domain polypeptide is provided. In some examples the library or population is designed to introduce modifications and/or diversity to a wild type or modified TetR polypeptide. In some examples, the library or population introduce at least one modification as exemplified in FIG. 9. In some examples the library or population comprises at least 10, 20, 30, 40, 50, 60, 70, 80, 90, 100, or greater distinct oligonucleotides. In some examples the library or population comprises oligonucleotides selected from the oligonucleotides shown in at least one of Table 2, 9, 12, 13, 15, 17, 19 or a combination thereof. In some examples the library or population comprises one or more oligonucleotides selected from the group consisting of SEQ ID NO: 833-882, 885-986, 987-059, 1060-1083, 1084-1124, 1125-1154, 1159-1205.

In some examples the sulfonylurea compound is an ethametsulfuron. In some examples the ethametsulfuron is provided at a concentration of about 0.001, 0.002, 0.003, 0.004, 0.005, 0.006, 0.007, 0.008, 0.009, 0.01, 0.02, 0.03, 0.04, 0.05, 0.06, 0.07, 0.08, 0.09, 0.10, 0.15, 0.2, 0.25, 0.3, 0.35, 0.4, 0.45, 0.5, 0.55, 0.6, 0.65, 0.7, 0.75, 0.8, 0.85, 0.9, 0.95, 1.0, 1.5, 2.0, 2.5, 3.0, 3.5, 4.0, 4.5, 5.0, 5.5, 6.0, 6.5, 7.0, 7.5, 8.0, 8.5, 9.0, 9.5, 10, 11, 12, 13, 14, 15, 16, 17, 18, 19, 20, 25, 30, 35, 40, 45, 50, 55, 60, 65, 70, 75, 80, 85, 90, 100, 200 or 500 µg/ml. In some examples the SuR polypeptide has a ligand binding domain having at least 50% 60%, 65%, 66%, 67%, 68%, 69%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98% or 99% sequence identity to an SuR polypeptide of SEQ ID NO: 205-401, 1206-1213, or 1228-1233, wherein the sequence identity is determined over the full length of the polypeptide using a global alignment method. In some examples the global alignment method is GAP, wherein the default parameters are for an amino acid sequence % identity and % similarity using GAP Weight of 8 and Length Weight of 2, and the BLOSUM62 scoring matrix. In some examples the polypeptide has a ligand binding domain from a SuR polypeptide selected from the group consisting of SEQ ID NO: 205-401, 1206-1213, 1228-1233, or 1240-1243. In some examples the polypeptide is selected from the group consisting of SEQ ID NO: 205-401, 1206-1213, 1228-1233, or 1240-1243. In some examples the polypeptide is encoded by a polynucleotide of SEQ ID NO: 636-832, 1214-1221, 1234-1239, or 1244-1247.

In some examples the sulfonylurea compound is chlorsulfuron. In some examples the chlorsulfuron is provided at a concentration of about 0.01, 0.02, 0.03, 0.04, 0.05, 0.06, 0.07, 0.08, 0.09, 0.10, 0.15, 0.2, 0.25, 0.3, 0.35, 0.4, 0.45, 0.5, 0.55, 0.6, 0.65, 0.7, 0.75, 0.8, 0.85, 0.9, 0.95, 1.0, 1.5, 2.0, 2.5, 3.0, 3.5, 4.0, 4.5, 5.0, 5.5, 6.0, 6.5, 7.0, 7.5, 8.0, 8.5, 9.0, 9.5, 10, 11, 12, 13, 14, 15, 16, 17, 18, 19, 20, 25, 30, 35, 40, 45, 50, 55, 60, 65, 70, 75, 80, 85, 90, 100, 200 or 500 µg/ml. In some examples the SuR polypeptide has a ligand binding domain having at least 50% 60%, 65%, 66%, 67%, 68%, 69%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98% or 99% sequence identity to an SuR polypeptide of SEQ ID NO: 14-204, wherein the sequence identity is determined over the full length of the polypeptide using a global alignment method. In some examples the global alignment method is GAP, wherein the default parameters are for an amino acid sequence % identity and % similarity using GAP Weight of 8 and Length Weight of 2 and the BLOSUM62 scoring matrix. In some examples the polypeptide has a ligand binding domain from a SuR polypeptide selected from the group consisting of SEQ ID NO: 14-204. In some examples the polypeptide is selected from the group consisting of SEQ ID NO: 14-204. In some examples the polypeptide is encoded by a polynucleotide of SEQ ID NO: 445-635.

The ability to capture value in various seed markets will require development of technology for controlling engineered trait distribution. One option is a trait deactivation/activation system using a chemically-regulated gene switch. To date no such system exists, in large part because of the lack of relevant chemistry, for example agricultural-compatible and/or pharmaceutical-based chemistry, that can be used as a ligand for a sensitive gene switch technology.

To develop an agricultural chemical-based ligand gene switch, TetR was modified using protein modeling, DNA shuffling, and a highly sensitive screening mechanism to produce a repressor that specifically recognizes sulfonylurea compounds. For agricultural applications, sulfonylurea compounds are phloem mobile and commercially available, thereby providing a good basis for use as switch ligand chemistry. Following three rounds of modeling and DNA shuffling, repressors that recognize SU chemistry nearly as well as wild type TetR recognizes cognate inducers and yet are totally specific to sulfonylurea chemistry have been generated.

These polypeptides comprise true sulfonylurea repressors (SuRs), which have been validated in planta using a newly developed transient assay system to demonstrate functionality of the SuR switch system. While exemplified in an agricultural context, these methods and compositions can be used in a wide variety of other settings and organisms.

In general, a chemical switch system wherein the chemical used penetrates rapidly and is perceived by all cell types in the organism, but does not perturb any endogenous regulatory networks will be most useful. Other important aspects have to do with the behavior of the sensor component, for example the stringency of regulation and response in the absence or presence of inducer. In general a switch system having tight regulation of the "off" state in the absence of inducer and rapid and intense response in the presence of inducer is preferred.

The ability to reversibly turn genes on and off has great utility for the analyses of gene expression and function, particularly for those genes whose products are toxic to the cell. A well characterized control mechanism in prokaryotes involves repressor proteins binding to operator DNA to prevent transcription initiation (Wray and Reznikoff (1983) *J Bacteriol* 156:1188-1191) and repressor-regulated systems have been developed for controlling expression, both in animals (Wirtz and Clayton (1995) *Science* 268:1179-1183; Deuschle et al. (1995) *Mol Cell Biol* 15:1097-1914; Furth et al. (1994) *Proc Natl Acad Sci USA* 91:9032-9306; Gossen and Bujard (1992) *Proc Natl Acad Sci USA* 89:5547-5551 and Gossen et al. (1995) *Science* 268:1766-1769) and plants (Wilde et al. (1992) *EMBO J* 11:1251-1259; Gatz et al. (1992) *Plant J* 2:397-404; Roder et al. (1994) *Mol Gen Genet* 243-32-38 and Ulmasov et al. (1997) *Plant Mol Biol* 35:417-424).

Two major repressor based systems have been successfully exploited for regulation of plant gene expression: the lac operator-repressor system (Ulmasov et al. (1997) *Plant Mol Biol* 35:417-424; Wilde et al. (1992) *EMBO J* 11:1251-1259) and the tet operator-repressor system (Wilde et al. (1992) *EMBO J* 11:1251-1259; Gatz et al. (1992) *Plant J* 2:397-404; Roder et al. (1994) *Mol Gen Genet* 243:32-38; Ulmasov et al. (1997) *Plant Mol Biol* 35:417-424). Both are repressor/operator based-systems deriving key elements from their corresponding prokaryotic operon, namely the *E. coli* lactose operon for lac and the transposon Tn10 tetracycline operon for tet. Generally, these systems control the activity of a promoter by placing operator sequences near the transcriptional start site of a gene such that gene expression from the operon is inhibited upon the binding of the repressor protein to its cognate operator sequence. However, in the presence of an inducing agent, the binding of the repressor to its operator is inhibited, thus activating the promoter and enabling gene expression. In the lac system, isopropyl-B-D-thiogalactopyranoside (IPTG) is the commonly used inducing agent, while tetracycline and/or doxycyline are commonly used inducing agents for the tet system.

Expression of the Tn10-operon is regulated by binding of the tet repressor to its operator sequences (Beck et al. (1982) *J Bacteriol* 150:633-642; Wray and Reznikoff (1983) *J Bacteriol* 156:1188-1191). The high specificity of tetracycline repressor for the tet operator, the high efficiency of induction by tetracycline and its derivatives, the low toxicity of the inducer, as well as the ability of tetracycline to easily permeate most cells, are the basis for the application of the tet system in somatic gene regulation in eukaryotic cells from animals (Wirtz and Clayton (1995) *Science* 268:1179-1183; Gossen et al. (1995) *Science* 268:1766-1769), humans (Deuschle et al. (1995) *Mol Cell Biol* 15:1907-1914; Furth et al. (1994) *Proc Natl Acad Sci USA* 91:9032-9306; Gossen and Bujard (1992) *Proc Natl Acad Sci USA* 89:5547-5551; Gossen et al. (1995) *Science* 268:1766-1769) and plant cell cultures (Wilde et al. (1992) *EMBO J* 11:1251-1259; Gatz et al. (1992) *Plant J* 2:397-404; Roder et al. (1994) *Mol Gen Genet* 243:32-28; Ulmasov et al. (1997) *Plant Mol Biol* 35:417-424).

A number of variations of tetracycline operator/repressor systems have been devised. For example, one system based on conversion of the tet repressor to an activator was developed via fusion of the repressor to a transcriptional transactivation domain such as herpes simplex virus VP16 and the tet repressor (tTA, Gossen and Bujard (1992) *Proc Natl Acad Sci USA* 89:5547-5551). In this system, a minimal promoter is activated in the absence of tetracycline by binding of tTA to tet operator sequences, and tetracycline inactivates the transactivator and inhibits transcription. This system has been used in plants (Weinmann et al. (1994) *Plant J* 5:559-569), rat hearts (Fishman et al. (1994) *J Clin Invest* 93:1864-1868) and mice (Furth et al. (1994) *Proc Natl Acad Sci USA* 91:9302-9306). However, there were indications that the chimeric tTA fusion protein was toxic to cells at levels required for efficient gene regulation (Bohl et al. (1996) *Nat Med* 3:299-305).

Promoters modified to be regulated by tetracycline and analogs thereof are known (Matzke et al. (2003) *Plant Mol Biol Rep* 21:9-19; Padidam (2003) *Curr Op Plant Biol* 6:169-177; Gatz and Quail (1988) *Proc Natl Acad Sci USA* 85:1394-1397; Ulmasov et al. (1997) *Plant Mol Biol* 35:417-424; Weinmann, et al. (1994) *Plant J* 5:559-569). One or more tet operator sequences can be added to a promoter in order to produce a tetracycline inducible promoter. In some examples up to 7 tet operators have been introduced upstream of a minimal promoter sequence and a TetR::VP16 activation domain fusion applied in trans activates expression only in the absence of inducer (Weinmann et al. (1994) *Plant J* 5:559-569; Love et al. (2000) *Plant J* 21:579-588). A widely tested tetracycline regulated expression system for plants using the CaMV 35S promoter was developed (Gatz et al. (1992) *Plant J* 2:397-404) having three tet operators introduced near the TATA box (3XOpT 35S). The 3XOpT 35S promoter generally functioned in tobacco and potato, however toxicity and poor plant phenotype in tomato and *Arabidopsis* (Gatz (1997) *Ann Rev Plant Physiol Plant Mol Biol* 48:89-108; Corlett et al. (1996) *Plant Cell Environ* 19:447-454) were also reported. Another factor is that the tetracycline-related chemistry is rapidly degraded in the light, which tends to confine its use to testing in laboratory conditions.

TetR has been subjected to DNA shuffling to modify its inducer specificity from tetracycline to 4-de(dimethylamino)-6-deoxy-6-demethyl-tetracycline (cmt3) a related but non-inducing compound (Scholz et al. (2003) *J Mol Biol* 329:217-227) which lacks chemical side groups at positions 4 and 6 and is therefore smaller than tetracycline. The specificity of TetR was altered by narrowing the ligand binding pocket, thereby sterically blocking the natural ligand tetracycline. The starting polypeptide was a TetR(BD) chimera consisting of amino acids 1-50 from TetR(B) and residues 51-208 from TetR(D). Several rounds of evolution and selection were used to shift TetR specificity from tetracycline to cmt3. Non-inducer cmt3 had little starting activity and was brought to the level of tetracycline, yielding an improvement in activity of several thousand-fold, and tetracycline has almost no inducing activity with the mutant repressors. While the ability to shift the specificity of TetR to the cmt3 ligand is exciting, it must be kept in mind that cmt3 is highly related to the natural tetracycline ligand. Based on these experiments, it is not obvious that TetR could be used as the basis for developing specificity to a completely different class of chemical ligands.

To produce a new chemical switch system, we re-designed the TetR system to recognize chemistry viable for use in agriculture. The re-design process was initiated by choosing a registered agrichemical compound having excellent plant uptake and distribution properties, as well as having a size and a shape reasonable for modeling into the wild type TetR ligand binding pocket. The compound chosen, thifensulfuron-methyl (Harmony®) is one of a family of commercially used sulfonylurea type herbicides inhibiting the key plant enzyme in branched chain amino acid biosynthesis, acetolactate synthase (ALS). Thifensulfuron (Ts) and related herbicides are structurally disparate to tetracycline, therefore it was unlikely they would have any starting activity with TetR. DNA shuffling is a powerful technology and can improve affinities for substrates or rate of substrate turnover by several thousand-fold, however has not yet been able to create de novo starting activity. To meet this gap in the evolution pathway a computer modeling strategy was sought that would narrow the search for meaningful amino acid diversity for shuffling. Recently developed modeling technology was used to re-train *E. coli* periplasmic binding proteins that normally bind to sugars to react to and initiate signaling with completely diverse sets of compounds such as serotonin, L-lactate and trinitrotoluene (Looger et al. (2003) *Nature* 423:185-190). Using protein design coupled with DNA shuffling and a very sensitive screening system, TetR protein variants that respond to thifensulfuron (Ts) and other related SU compounds have been identified. Following several rounds of DNA shuffling, TetR variants were developed having genetic switch capability with SU ligands (SuRs) similar to that of TetR with tetracycline inducers.

Any method of rational protein design can be used alone or in combination. For example, phylogenetic diversity within a family of protein sequences can be used to identify positions in the primary structure having amino acid substitutions, and the types of substitutions that have occurred and their impact on function. Conserved domain families can also be aligned and similarly examined to identify positions in the primary structure having amino acid substitutions and the types of substitutions that have occurred and the impact on function. The secondary structure(s) and functional domains can be evaluated and various models used to predict tolerance or impact of amino acid substitutions on structure and function. Modeling using the tertiary and/or quaternary structure and ligand, substrate and/or cofactor binding provide further insights into the effects of amino acid substitutions and/or alternate ligands, substrates and/or cofactors interactions with the polypeptide.

To examine the phylogenetic diversity of tetracycline repressors, both a broad family of tetracycline repressor proteins as well as closely related tetracycline repressors were used. Thirty-four proteins were identified and aligned to examine the amino acid diversity at various positions in the repressor family (SEQ ID NO: 1 and 402-433). The broad family of tetracycline repressors comprised a TetR(D) mutant whose structure was determined by crystallization PDB_1A6I (Orth et al. (1998) *J Mol Biol* 279:439-447) and public sequence deposit accessions A26948, AAA98409, AAD12754, AAD25094, AAD25537, AAP93923, AAR96033, AAW66496, AAW83818, AB014708, ABS19067, CAA24908, CAC80726, CAC81917, EAY62734, NP_387455, NP_387462, NP_511232, NP_824556, P51560, YP_001220607, YP_001370475, YP_368094, YP_620166, YP_772551, ZP_00132379, ZP_01558383, and ZP_01567051. Closely related tetracycline repressors included TetR(A) P03038, TetR(B) P04483, TetR(D) P0ACT4, TetR(E) P21337 and TetR(H) P51561. The alignments of these sequences were used to look at overall sequence diversity as well as diversity in the DNA and the ligand binding domains (see, Example 1 H, SEQ ID NO: 1 and 402-433).

The modular architecture of repressor proteins and the commonality of helix-turn-helix DNA binding domains allows for the creation of SuR polypeptides having altered DNA binding specificity. For example, the DNA binding specificity can be altered by fusing a SuR ligand binding domain to an alternate DNA binding domain. For example, the DNA binding domain from TetR class D can be fused to an SuR ligand binding domain to create SuR polypeptides that specifically bind to polynucleotides comprising a class D tetracycline operator. In some examples a DNA binding domain variant or derivative can be used. For example, a DNA binding domain from a TetR variant that specifically recognizes a tetO-4C operator or a tetO-6C operator could be used (Helbl and Hillen (1998) *J Mol Biol* 276:313-318; Helbl et al. (1998) *J Mol Biol* 276:319-324. The four helix bundle formed by helices α8 and α10 in both subunits can be substituted to ensure dimerization specificity when targeting two different operator specific repressor variants in the same cell to prevent heterodimerization (e.g., Rossi et al. (1998) *Nat Genet* 20:389-393; Berens and Hillen (2003) *Eur J Biochem* 270: 3109-3121). In another example, the DNA binding domain from LexA repressor was fused to GAL4 wherein this hybrid protein recognized LexA operators in both *E. coli* and yeast (Brent and Ptashne (1985) *Cell* 43:729-736). In another example, all of the presumptive DNA binding or DNA-recognition R-groups of the 434 repressor were replaced by the corresponding positions of the P22 repressor. Operator binding specificity of the hybrid repressor 434R[α3(P22R)] was tested both in vivo and in vitro and each test showed that this targeted modification of 434 shifted the DNA binding specificity from 434 operator to P22 operator (Wharton and Ptashne (1985) *Nature* 316:601-605). This work was further extended by creating a heterodimer of wild type 434R and 434R[α3(P22R)] which then specifically recognized a chimeric P22/434 operator sequence (Hollis et al. (1988) *Proc Natl Acad Sci USA* 85:5834-5838). In another example, the N-terminal half of the AraC protein was fused to the LexA repressor DNA binding domain. The resulting AraC:LexA chimera dimerized, bound LexA operator, and repressed expression of a LexA operator:β-galactosidase fusion gene in an arabinose-responsive manner (Bustos and Schleif (1993) *Proc Natl Acad Sci USA* 90:5638-5642).

The isolated polynucleotides encoding SuR polypeptides can also be used as substrates for diversity-generating procedures, including mutation, recombination, and recursive recombination reactions, to produce additional SuR polynucleotide and/or polypeptide variants with desired properties. Additionally, the SuR polynucleotides can be used for diversity-generating procedures to produce polynucleotide and/or polypeptide variants having an altered characteristic as compared to the starting material, for example binding to a different ligand inducer. The diversity-generating process produces sequence alterations including single nucleotide substitutions, multiple nucleotide substitutions and insertion or deletion of regions of the nucleic acid sequence. The diversity-generating procedures can be used separately and/or in combination to produce one or more SuR variants or set of variant as well variants of encoded proteins. Individually and collectively, these procedures provide robust, widely applicable ways of generating diversified polynucleotides and polypeptides, as well as sets of polynucleotides and polypeptides, including, libraries. These variants and sets of variants are useful for the engineering or rapid evolution of polynucleotides, proteins, pathways, cells and/or organisms with new and/or improved characteristics. The resulting polynucleotide and/or polypeptide variants can be selected or screened for altered characteristics and/or properties, including altered ligand binding, retention of DNA binding, and/or quantification of binding properties.

Any method can be used to provide sequence diversity to a library. Many diversity-generating procedures, including multigene shuffling and methods for generating modified nucleic acid sequences are available, including for example, Soong et al. (2000) *Nat Genet* 25:436-39; Stemmer et al. (1999) *Tumor Targeting* 4:1-4; Ness et al. (1999) *Nature Biotech* 17:893-896; Chang et al. (1999) *Nature Biotech* 17:793-797; Minshull and Stemmer (1999) *Curr Op Chem Biol* 3:284-290; Christians et al. (1999) *Nature Biotech* 17:259-264; Crameri et al. (1998) *Nature* 391:288-291; Crameri et al. (1997) *Nature Biotech* 15:436-438; Zhang et al. (1997) *Proc Natl Acad Sci USA* 94:4504-4509; Patten et al. (1997) *Curr Op Biotech* 8:724-733; Crameri et al. (1996) *Nature Med* 2:100-103; Crameri et al. (1996) *Nature Biotech* 14:315-319; Gates et al. (1996) *J Mol Biol* 255:373-386; Stemmer (1996) "Sexual PCR and Assembly PCR" in The Encyclopedia of Molecular Biology (VCH Publishers, New York) pp. 447-457; Crameri and Stemmer (1995) *BioTechniques* 18:194-195; Stemmer et al. (1995) *Gene* 164:49-53; Stemmer (1995) *Science* 270:1510; Stemmer (1995) *Bio/Technology* 13:549-553; Stemmer (1994) *Nature* 370:389-391 and Stemmer (1994) *Proc Natl Acad Sci USA* 91:10747-10751. Mutational methods to generate diversity include, for example, site-directed mutagenesis (Ling et al. (1997) *Anal Biochem* 254:157-178; Dale et al. (1996) *Methods Mol Biol* 57:369-374; Smith (1985) *Ann Rev Genet* 19:423-462; Botstein and Shortle (1985) *Science* 229:1193-1201; Carter (1986) *Biochem J* 237:1-7 and Kunkel (1987) "The efficiency of oligonucleotide directed mutagenesis" in Nucleic Acids and Molecular Biology (Eckstein and Lilley, eds., Springer Verlag, Berlin). Mutagenesis methods using uracil containing templates included Kunkel (1985) *Proc Natl Acad Sci USA* 82:488-492; Kunkel et al. (1987) *Methods Enzymol* 154:367-382; and Bass et al. (1988) *Science* 242:240-245. Oligonucleotide-directed mutagenesis methods include Zoller and Smith (1983) *Methods Enzymol* 100:468-500; Zoller and Smith (1982) *Nucl Acids Res* 10:6487-6500 and Zoller and Smith (1987) *Methods Enzymol* 154:329-350. Phosphorothioate-modified DNA mutagenesis methods include Taylor et al. (1985) *Nucl Acids Res* 13:8749-8764; Taylor et al. (1985) *Nucl Acids Res* 13:8765-8787; Nakamaye and Eckstein (1986) *Nucl Acids Res* 14:9679-9698; Sayers et al. (1988) *Nucl Acids Res* 16:791-802 and Sayers et al. (1988) *Nucl Acids Res* 16:803-814. Mutagenesis methods using gapped duplex DNA include (Kramer et al. (1984) *Nucl Acids Res* 12:9441-9456; Kramer and Fritz (1987) *Methods Enzymol* 154:350-367; Kramer et al. (1988) *Nucl Acids Res* 16:7207; and Fritz et al. (1988) *Nucl Acids Res* 16:6987-6999. Additional suitable diversity-generating methods include point mismatch repair (Kramer et al. (1984) *Cell* 38:879-887); mutagenesis using repair-deficient host strains (Carter et al. (1985) *Nucl Acids Res* 13:4431-4443; and Carter (1987) *Methods Enzymol* 154:382-403); deletion mutagenesis (Eghtedarzadeh and Henikoff (1986) *Nucl Acids Res* 14: 5115); restriction-selection and restriction-purification (Wells et al. (1986) *Phil Trans R Soc Lond A* 317:415-423); mutagenesis by total gene synthesis (Nambiar et al. (1984) *Science* 223:1299-1301; Sakamar and Khorana (1988) *Nucl Acids Res* 14:6361-6372; Wells et al. (1985) *Gene* 34:315-323 and Grundström et al. (1985) *Nucl Acids Res.* 13:3305-3316); double-strand break repair (Mandecki (1986) *Proc Natl Acad Sci USA* 83:7177-7181; and Arnold (1993) *Curr Op Biotech* 4:450-455). Nucleic acids can be recombined in vitro by any technique or combination of techniques including, e.g., DNAse digestion of nucleic acids to be recombined followed by ligation and/or PCR reassembly of the nucleic acids. For example, sexual PCR mutagenesis can be used in which fragmentation of the DNA molecule is followed by recombination in vitro, based on sequence similarity, between DNA molecules with different but related DNA sequences, followed by fixation of the crossover by extension in a polymerase chain reaction. Similarly, nucleic acids can be recursively recombined in vivo, e.g., by allowing recombination to occur between nucleic acids in cells. Such formats optionally provide direct recombination between nucleic acids of interest, or provide recombination between constructs, vectors, viruses, and/or plasmids comprising the nucleic acids of interest. Whole genome recombination methods can also be used wherein whole genomes of cells or other organisms are recombined, optionally including spiking of the genomic recombination mixtures with desired library components. These methods have many applications, including those in which the identity of a target gene is not known. Any of these processes can be used alone or in combination to generate polynucleotides encoding SuR polypeptides. Any of the diversity-generating methods can be used in a reiterative fashion, using one or more cycles of mutation/recombination or other diversity generation methods, optionally followed by one or more selection methods to generate additional recombinant nucleic acids.

For convenience and high throughput it will often be desirable to screen/select for desired modified nucleic acids in a microorganism, such as in a bacteria such as *E. coli*, or unicellular eukaryote such as yeast including *S. cerevisiae*, *S. pombe*, *P. pastoris* or protists such as *Chlamydomonas*, or in model cell systems such as SF9, Hela, CHO, BMS, BY2, or other cell culture systems. In some instances, screening in plant cells or plants may be desirable, including plant cell or explant culture systems or model plant systems such as *Arabidopsis*, or tobacco. In some examples throughput is increased by screening pools of host cells expressing different modified nucleic acids, either alone or as part of a gene fusion construct. Any pools showing significant activity can be deconvoluted to identify single clones expressing the desirable activity.

Recombinant constructs comprising one or more of nucleic acid sequences encoding a SuR polypeptide are provided. The constructs comprise a vector, such as, a plasmid, a cosmid, a phage, a virus, a bacterial artificial chromosome (BAC), a yeast artificial chromosome (YAC), or the like, into which a polynucleotide encoding a SuR polypeptide has been inserted. In some examples, the construct further comprises regulatory sequences, including, for example, a promoter, operably linked to the sequence. Suitable vectors are well known and include chromosomal, non-chromosomal and synthetic DNA sequences, such as derivatives of SV40; bacterial plasmids; replicons; phage DNA; baculovirus; yeast plasmids; vectors derived from combinations of plasmids and phage DNA, viral DNA such as vaccinia, adenovirus, fowl pox virus, pseudorabies, adenovirus, adeno-associated viruses, retroviruses, geminiviruses, TMV, PVX, other plant viruses, Ti plasmids, Ri plasmids and many others.

The vectors may optionally contain one or more selectable marker genes to provide a phenotypic trait for selection of transformed host cells. Usually, the selectable marker gene will encode antibiotic or herbicide resistance. Suitable genes include those coding for resistance to the antibiotic spectinomycin or streptomycin (e.g., the aadA gene), the streptomycin phosphotransferase (SPT) gene for streptomycin resistance, the neomycin phosphotransferase (NPTII or NPTIII) gene kanamycin or geneticin resistance, the hygromycin phosphotransferase (HPT) gene for hygromycin resistance. Additional selectable marker genes include dihydrofolate reductase or neomycin resistance for eukaryotic cell culture and tetracycline or ampicillin resistance. Genes coding for resistance to herbicides include those which act to inhibit the action of glutamine synthase, such as phosphinothricin or basta (e.g., the bar gene), EPSPS, GOX, or GAT which provide resistance to glyphosate, mutant ALS (acetolactate synthase) which provides resistance to sulfonylurea type herbicides or any other known genes.

In bacterial systems a number of expression vectors are available. Such vectors include, but are not limited to, multifunctional *E. coli* cloning and expression vectors such as BLUESCRIPT (Stratagene); pIN vectors (Van Heeke and Schuster, (1989) *J Biol Chem* 264:5503-5509); pET vectors (Novagen, Madison Wis.) and the like. Similarly, in *S. cerevisiae* a number of vectors containing constitutive or inducible promoters such as alpha factor, alcohol oxidase and PGH may be used for production of polypeptides. For reviews, see, Ausubel and Grant et al. (1987) *Meth Enzymol* 153:516-544. A variety of expression systems can be used in mammalian host cells, including viral-based systems, such as adenovirus and rous sarcoma virus (RSV) systems. Any number of commercially or publicly available expression systems or derivatives thereof can be used.

In plant cells expression can be driven from an expression cassette integrated into a plant chromosome, or an organelle, or cytoplasmically from an episomal or viral nucleic acid. Numerous plant derived regulatory sequences have been described, including sequences which direct expression in a tissue specific manner, e.g., TobRB7, patatin B33, GRP gene promoters, the rbcS-3A promoter and the like. Alternatively, high level expression can be achieved by transiently expressing exogenous sequences of a plant viral vector, e.g., TMV, BMV, geminiviruses including WDV and the like.

Typical vectors useful for expression of nucleic acids in higher plants are known including vectors derived from the tumor-inducing (Ti) plasmid of *Agrobacterium tumefaciens* described by Rogers et al. (1987) *Meth Enzymol* 153:253-277. Exemplary *A. tumefaciens* vectors include plasmids pKYLX6 and pKYLX7 of Schardl et al. (1987) *Gene* 61:1-11 and Berger et al. (1989) *Proc Natl Acad Sci USA* 86:8402-8406 and plasmid pB101.2 that is available from Clontech Laboratories, Inc. (Palo Alto, Calif.). A variety of known plant viruses can be employed as vectors including cauliflower mosaic virus (CaMV), geminiviruses, brome mosaic virus and tobacco mosaic virus.

The SuR may be used to control expression of a polynucleotide of interest. The polynucleotide of interest may be any sequence of interest, including but not limited to sequences encoding a polypeptide, encoding an mRNA, encoding an RNAi precursor, encoding an active RNAi agent, a miRNA, an antisense polynucleotide, a ribozyme, a fusion protein, a replicating vector, a screenable marker, and the like. Expression of the polynucleotide of interest may be used to induce expression of an encoding RNA and/or polypeptide, or conversely to suppress expression of an encoded RNA, RNA target sequence, and/or polypeptide. In specific examples, the polynucleotide sequence may a polynucleotide encoding a plant hormone, plant defense protein, a nutrient transport protein, a biotic association protein, a desirable input trait, a desirable output trait, a stress resistance gene, a herbicide resistance gene, a disease/pathogen resistance gene, a male sterility, a developmental gene, a regulatory gene, a DNA repair gene, a transcriptional regulatory gene or any other polynucleotide and/or polypeptide of interest.

A number of promoters can be used in the compositions and methods. For example, a polynucleotide encoding a SuR polypeptide can be operably linked to a constitutive, tissue-preferred, inducible, developmentally, temporally and/or spatially regulated or other promoters including those from plant viruses or other pathogens which function in a plant cell. A variety of promoters useful in plants is reviewed in Potenza et al. (2004) *In Vitro Cell Dev Biol Plant* 40:1-22.

Any polynucleotide, including polynucleotides of interest, polynucleotides encoding SuRs, regulatory regions, introns, promoters, and promoters comprising TetOp sequences may be obtained and their nucleotide sequence determined, by any standard method. The polynucleotides may be chemically synthesized in their full-length or assembled from chemically synthesized oligonucleotides (Kutmeier et al. (1994) *BioTechniques* 17:242). Assembly from oligonucleotides typically involves synthesis of overlapping oligonucleotides, annealing and ligating of those oligonucleotides and PCR amplification of the ligated product. Alternatively, a polynucleotide may be isolated or generated from a suitable source including suitable source a cDNA library generated from tissue or cells, a genomic library, or directly isolated from a host by PCR amplification using specific primers to the 3' and 5' ends of the sequence or by cloning using an nucleotide probe specific for the polynucleotide of interest. Amplified nucleic acid molecules generated by PCR may then be cloned into replicable cloning vectors using standard methods. The polynucleotide may be further manipulated using any standard methods including recombinant DNA techniques, vector construction, mutagenesis and PCR (see, e.g., Sambrook et al. (1990) Molecular Cloning, A Laboratory Manual, 2d Ed., Cold Spring Harbor Laboratory, Cold Spring Harbor, N.Y.; Ausubel et al., Eds. (1998) Current Protocols in Molecular Biology, John Wiley and Sons, NY).

Any method for introducing a sequence into a cell or organism can be used, as long as the polynucleotide or polypeptide gains access to the interior of at least one cell. Methods for introducing sequences into plants are known and include, but are not limited to, stable transformation, transient transformation, virus-mediated methods, and sexual breeding. Stably incorporated indicates that the introduced polynucleotide is integrated into a genome and is capable of being inherited by progeny. Transient transformation indicates that an introduced sequence does not integrate into a genome such that it is heritable by progeny from the host. Any means can be used to bring together a SuR and polynucleotide of interest operably linked to a promoter comprising TetOp including, for example, stable transformation, transient delivery, cell fusion, sexual crossing or any combination thereof.

Transformation protocols as well as protocols for introducing polypeptides or polynucleotide sequences into plants may vary depending on the type of plant or plant cell targeted for transformation. Suitable methods of introducing polypeptides and polynucleotides into plant cells include microinjection (Crossway et al. (1986) *Biotechniques* 4:320-334 and U.S. Pat. No. 6,300,543), electroporation (Riggs et al. (1986) *Proc Natl Acad Sci USA* 83:5602-5606, *Agrobacterium*-mediated transformation (U.S. Pat. Nos. 5,563,055 and 5,981, 840), direct gene transfer (Paszkowski et al. (1984) *EMBO J* 3:2717-2722), ballistic particle acceleration (U.S. Pat. Nos. 4,945,050, 5,879,918, 5,886,244 and 5,932,782; Tomes et al. (1995) in Plant Cell, Tissue and Organ Culture: Fundamental Methods, ed. Gamborg and Phillips (Springer-Verlag, Berlin); McCabe et al. (1988) *Biotechnology* 6:923-926). Also see, Weissinger et al. (1988) *Ann Rev Genet* 22:421-477;

Sanford et al. (1987) Particulate *Science and Technology* 5:27-37; Christou et al. (1988) *Plant Physiol* 87:671-674; Finer and McMullen (1991) *In Vitro Cell Dev Biol* 27P:175-182 (soybean); Singh et al. (1998) *Theor Appl Genet* 96:319-324; Datta et al. (1990) *Biotechnology* 8:736-740; Klein et al. (1988) *Proc Natl Acad Sci USA* 85:4305-4309; Klein et al. (1988) *Biotechnology* 6:559-563; U.S. Pat. Nos. 5,240,855, 5,322,783 and 5,324,646; Klein et al. (1988) *Plant Physiol* 91:440-444; Fromm et al. (1990) *Biotechnology* 8:833-839; Hooykaas-Van Slogteren et al. (1984) *Nature* 311:763-764; U.S. Pat. No. 5,736,369; Bytebier et al. (1987) *Proc Natl Acad Sci USA* 84:5345-5349; De Wet et al. (1985) in The Experimental Manipulation of Ovule Tissues, ed. Chapman et al. (Longman, N.Y.), pp. 197-209; Kaeppler et al. (1990) *Plant Cell Rep* 9:415-418; Kaeppler et al. (1992) *Theor Appl Genet* 84:560-566; D'Halluin et al. (1992) *Plant Cell* 4:1495-1505; Li et al. (1993) *Plant Cell Rep* 12:250-255; Christou and Ford (1995) *Ann Bot* 75:407-413 and Osjoda et al. (1996) *Nat Biotechnol* 14:745-750. Alternatively, polynucleotides may be introduced into plants by contacting plants with a virus, or viral nucleic acids. Methods for introducing polynucleotides into plants via viral DNA or RNA molecules are known, see, e.g., U.S. Pat. Nos. 5,889,191, 5,889,190, 5,866,785, 5,589,367, 5,316,931 and Porta et al. (1996) *Mol Biotech* 5:209-221.

The term plant includes plant cells, plant protoplasts, plant cell tissue cultures from which a plant can be regenerated, plant calli, plant clumps and plant cells that are intact in plants or parts of plants such as embryos, pollen, ovules, seeds, leaves, flowers, branches, fruit, kernels, ears, cobs, husks, stalks, roots, root tips, anthers and the like. Progeny, variants and mutants of the regenerated plants are also included.

In some examples, a SuR may be introduced into a plastid, either by transformation of the plastid or by directing a SuR transcript or polypeptide into the plastid. Any method of transformation, nuclear or plastid, can be used, depending on the desired product and/or use. Plastid transformation provides advantages including high transgene expression, control of transgene expression, ability to express polycistronic messages, site-specific integration via homologous recombination, absence of transgene silencing and position effects, control of transgene transmission via uniparental plastid gene inheritance and sequestration of expressed polypeptides in the organelle which can obviate possible adverse impacts on cytoplasmic components (e.g., see, reviews including Heifetz (2000) *Biochimie* 82:655-666; Daniell et al. (2002) *Trends Plant Sci* 7:84-91; Maliga (2002) *Curr Op Plant Biol* 5:164-172; Maliga (2004) *Ann Rev Plant Biol* 55-289-313; Daniell et al. (2005) *Trends Biotechnol* 23:238-245 and Verma and Daniell (2007) *Plant Physiol* 145:1129-1143).

Methods and compositions of plastid transformation are well known, for example, transformation methods include (Boynton et al. (1988) *Science* 240:1534-1538; Svab et al. (1990) *Proc Natl Acad Sci USA* 87:8526-8530; Svab et al. (1990) *Plant Mol Biol* 14:197-205; Svab et al. (1993) *Proc Natl Acad Sci USA* 90:913-917; Golds et al. (1993) *Bio/Technology* 11:95-97; O'Neill et al. (1993) *Plant J* 3:729-738; Koop et al. (1996) *Planta* 199:193-201; Kofer et al. (1998) *In Vitro Plant* 34:303-309; Knoblauch et al. (1999) *Nat Biotechnol* 17:906-909); as well as plastid transformation vectors, elements, and selection (Newman et al. (1990) *Genetics* 126:875-888; Goldschmidt-Clermont, (1991) *Nucl Acids Res* 19:4083-4089; Carrer et al. (1993) *Mol Gen Genet* 241:49-56; Svab et al. (1993) *Proc Natl Acad Sci USA* 90:913-917; Verma and Daniell (2007) *Plant Physiol* 145: 1129-1143).

Methods and compositions for controlling gene expression in plastids are well known including (McBride et al. (1994) *Proc Natl Acad Sci USA* 91:7301-7305; Lössl et al. (2005) *Plant Cell Physiol* 46:1462-1471; Heifetz (2000) *Biochemie* 82:655-666; Surzycki et al. (2007) *Proc Natl Acad Sci USA* 104:17548-17553; U.S. Pat. Nos. 5,576,198 and 5,925,806; WO 2005/0544478), as well as methods and compositions to import polynucleotides and/or polypeptides into a plastid, including translational fusion to a transit peptide (e.g., Comai et al. (1988) *J Biol Chem* 263:15104-15109).

The SuR polynucleotides and polypeptides provide a means for regulating plastid gene expression via a chemical inducer that readily enters the cell. For example, using the T7 expression system for chloroplasts (McBride et al. (1994) *Proc Natl Acad Sci USA* 91:7301-7305) the SuR could be used to control nuclear T7 polymerase expression. Alternatively, an SuR-regulated promoter could be integrated into the plastid genome and operably linked to the polynucleotide(s) of interest and the SuR expressed and imported from the nuclear genome, or integrated into the plastid. In all cases, application of a sulfonylurea compound is used to efficiently regulate the polynucleotide(s) of interest.

Any type of cell and/or organism, prokaryotic or eukaryotic, can be used with the SuR methods and compositions. For example, any bacterial cell system can be transformed with the compositions. For example, methods of *E. coli, Agrobacterium* and other bacterial cell transformation, plasmid preparation and the use of phages are detailed, for example, in Current Protocols in Molecular Biology (Ausubel, et al., (eds.) (1994) a joint venture between Greene Publishing Associates, Inc. and John Wiley & Sons, Inc.).

The SuR systems can be used with any eukaryotic cell line, including yeasts, protists, algae, insect cells, avian or mammalian cells. For example, many commercially and/or publicly available strains of *S. cerevisiae* are available, as are the plasmids used to transform these cells. For example, strains are available from the American Type Culture Collection (ATCC, Manassas, Va.) and include the Yeast Genetic Stock Center inventory, which moved to the ATCC in 1998. Other yeast lines, such as *S. pombe* and *P. pastoris*, and the like are also available. For example, methods of yeast transformation, plasmid preparation, and the like are detailed, for example, in Current Protocols in Molecular Biology (Ausubel et al. (eds.) (1994) a joint venture between Greene Publishing Associates, Inc. and John Wiley & Sons, Inc., see Unit 13 in particular). Transformation methods for yeast include spheroplast transformation, electroporation, and lithium acetate methods. A versatile, high efficiency transformation method for yeast is described by Gietz and Woods ((2002) *Methods Enzymol* 350:87-96) using lithium acetate, PEG 3500 and carrier DNA.

The SuRs can be used in mammalian cells, such as CHO, HeLa, BALB/c, fibroblasts, mouse embryonic stem cells and the like. Many commercially available competent cell lines and plasmids are well known and readily available, for example from the ATCC (Manassas, Va.). Isolated polynucleotides for transformation and transformation of mammalian cells can be done by any method known in the art. For example, methods of mammalian and other eukaryotic cell transformation, plasmid preparation, and the use of viruses are detailed, for example, in Current Protocols in Molecular Biology (Ausubel et al. (eds.) (1994) a joint venture between Greene Publishing Associates, Inc. and John Wiley & Sons, Inc., see, Unit 9 in particular). For example, many methods are available, such as calcium phosphate transfection, electroporation, DEAE-dextran transfection, liposome-mediated transfection, microinjection as well as viral techniques.

Any plant species can be used with the SuR methods and compositions, including, but not limited to, monocots and dicots. Examples of plants include, but are not limited to, corn (*Zea mays*), *Brassica* spp. (e.g., *B. napus, B. rapa, B. juncea*), castor, palm, alfalfa (*Medicago sativa*), rice (*Oryza sativa*), rye (*Secale cereale*), sorghum (*Sorghum bicolor, Sorghum vulgare*), millet (e.g., pearl millet (*Pennisetum glaucum*), proso millet (*Panicum miliaceum*), foxtail millet (*Setaria italica*), finger millet (*Eleusine coracana*)), sunflower (*Helianthus annuus*), safflower (*Carthamus tinctorius*), wheat (*Triticum aestivum*), soybean (*Glycine max*), tobacco (*Nicotiana tabacum*), potato (*Solanum tuberosum*), peanuts (*Arachis hypogaea*), cotton (*Gossypium barbadense, Gossypium hirsutum*), sweet potato (*Ipomoea batatus*), cassava (*Manihot esculenta*), coffee (*Coffea* spp.), coconut (*Cocos nucifera*), pineapple (*Ananas comosus*), citrus trees (*Citrus* spp.), cocoa (*Theobroma cacao*), tea (*Camellia sinensis*), banana (*Musa* spp.), avocado (*Persea americana*), fig (*Ficus casica*), guava (*Psidium guajava*), mango (*Mangifera indica*), olive (*Olea europaea*), papaya (*Carica papaya*), cashew (*Anacardium occidentale*), macadamia (*Macadamia integrifolia*), almond (*Prunus amygdalus*), sugar beets (*Beta vulgaris*), sugarcane (*Saccharum* spp.), *Arabidopsis thaliana*, oats (*Avena* spp.), barley (*Hordeum* spp.), leguminous plants such as guar beans, locust bean, fenugreek, garden beans, cowpea, mungbean, fava bean, lentils, and chickpea, vegetables, ornamentals, grasses and conifers. Vegetables include tomatoes (*Lycopersicon esculentum*), lettuce (e.g., *Lactuca sativa*), green beans (*Phaseolus vulgaris*), lima beans (*Phaseolus limensis*), peas (*Pisium* spp., *Lathyrus* spp.), and *Cucumis* species such as cucumber (*C. sativus*), cantaloupe (*C. cantalupensis*), and musk melon (*C. melo*). Ornamentals include azalea (*Rhododendron* spp.), hydrangea (*Macrophylla hydrangea*), hibiscus (*Hibiscus rosasanensis*), roses (*Rosa* spp.), tulips (*Tulipa* spp.), daffodils (*Narcissus* spp.), petunias (*Petunia hybrida*), carnation (*Dianthus caryophyllus*), poinsettia (*Euphorbia pulcherrima*), and chrysanthemum. Conifers include pines, for example, loblolly pine (*Pinus taeda*), slash pine (*Pinus elliotii*), ponderosa pine (*Pinus ponderosa*), lodgepole pine (*Pinus contorta*), and Monterey pine (*Pinus radiata*), Douglas fir (*Pseudotsuga menziesii*); Western hemlock (*Tsuga canadensis*), Sitka spruce (*Picea glauca*), redwood (*Sequoia sempervirens*), true firs such as silver fir (*Abies amabilis*) and balsam fir (*Abies balsamea*) and cedars such as Western red cedar (*Thuja plicata*) and Alaska yellow cedar (*Chamaecyparis nootkatensis*).

The plant cells and/or tissue that have been transformed may be grown into plants using conventional methods (see, e.g., McCormick et al. (1986) *Plant Cell Rep* 5:81-84). These plants may then be grown and self-pollinated, backcrossed, and/or outcrossed, and the resulting progeny having the desired characteristic identified. Two or more generations may be grown to ensure that the characteristic is stably maintained and inherited and then seeds harvested. In this manner transformed/transgenic seed having a DNA construct comprising a polynucleotide of interest and/or modified polynucleotide encoding an SuR stably incorporated into their genome are provided. A plant and/or a seed having stably incorporated the DNA construct can be further characterized for expression, agronomics and copy number.

Sequence identity may be used to compare the primary structure of two polynucleotides or polypeptide sequences, describe the primary structure of a first sequence relative to a second sequence, and/or describe sequence relationships such as variants and homologues. Sequence identity measures the residues in the two sequences that are the same when aligned for maximum correspondence. Sequence relationships can be analyzed using computer-implemented algorithms. The sequence relationship between two or more polynucleotides or two or more polypeptides can be determined by computing the best alignment of the sequences and scoring the matches and the gaps in the alignment, which yields the percent sequence identity and the percent sequence similarity. Polynucleotide relationships can also be described based on a comparison of the polypeptides each encodes. Many programs and algorithms for comparison and analysis of sequences are known. Unless otherwise stated, sequence identity/similarity values provided herein refer to the value obtained using GAP Version 10 (GCG, Accelrys, San Diego, Calif.) using the following parameters: % identity and % similarity for a nucleotide sequence using GAP Weight of 50 and Length Weight of 3, and the nwsgapdna.cmp scoring matrix; % identity and % similarity for an amino acid sequence using GAP Weight of 8 and Length Weight of 2, and the BLOSUM62 scoring matrix (Henikoff and Henikoff (1992) *Proc Natl Acad Sci USA* 89:10915-10919). GAP uses the algorithm of Needleman and Wunsch (1970) *J Mol Biol* 48:443-453, to find the alignment of two complete sequences that maximizes the number of matches and minimizes the number of gaps.

Alternatively, polynucleotides and/or polypeptides can be evaluated using other sequence tools. For example, polynucleotides and/or polypeptides can be evaluated using a BLAST alignment tool. A local alignment gaps consists simply of a pair of sequence segments, one from each of the sequences being compared. A modification of Smith-Waterman or Sellers algorithms will find all segment pairs whose scores cannot be improved by extension or trimming, called high-scoring segment pairs (HSPs). The results of the BLAST alignments include statistical measures to indicate the likelihood that the BLAST score can be expected from chance alone. The raw score, S, is calculated from the number of gaps and substitutions associated with each aligned sequence wherein higher similarity scores indicate a more significant alignment. Substitution scores are given by a look-up table (see PAM, BLOSUM). Gap scores are typically calculated as the sum of G, the gap opening penalty and L, the gap extension penalty. For a gap of length n, the gap cost would be G+Ln. The choice of gap costs, G and L is empirical, but it is customary to choose a high value for G (10-15) and a low value for L (1-2). The bit score, S', is derived from the raw alignment score S in which the statistical properties of the scoring system used have been taken into account. Bit scores are normalized with respect to the scoring system, therefore they can be used to compare alignment scores from different searches. The E-Value, or expected value, describes the likelihood that a sequence with a similar score will occur in the database by chance. It is a prediction of the number of different alignments with scores equivalent to or better than S that are expected to occur in a database search by chance. The smaller the E-Value, the more significant the alignment. For example, an alignment having an E value of $e^{-117}$ means that a sequence with a similar score is very unlikely to occur simply by chance. Additionally, the expected score for aligning a random pair of amino acid is required to be negative, otherwise long alignments would tend to have high score independently of whether the segments aligned were related. Additionally, the BLAST algorithm uses an appropriate substitution matrix, nucleotide or amino acid and for gapped alignments uses gap creation and extension penalties. For example, BLAST alignment and comparison of polypeptide sequences are typically done using the BLOSUM62 matrix, a gap existence penalty of 11 and a gap extension penalty of 1. Unless otherwise stated, scores reported from BLAST analyses were done using the BLOSUM62 matrix, a gap existence penalty of 11 and a gap extension penalty of 1.

UniProt protein sequence database is a repository for functional and structural protein data and provides a stable, comprehensive, fully classified, richly and accurately annotated protein sequence knowledgebase, with extensive crossreferences and querying interfaces freely accessible to the scientific community. The UniProt site has a tool, UniRef, that provides a cluster of proteins have 50%, 90% or 100% sequence identity to a protein sequence of interest from the database. For example, using TetR(B) (UniProt reference P04483) gives a cluster of 18 proteins having 90% sequence identity to P04483:

| RefID | Protein Name | Species | Length |
|---|---|---|---|
| P04483 | TetR class B from transposon Tn10 | E. coli | 207 |
| B1VCF0 | TetR protein | E. coli | 208 |
| A0ZSZ1 | Tetracycline resistant gene repressor | Photobacterium sp. TC21 | 208 |
| A4LA82 | Tetracycline repressor protein | Edwardsiella tarda | 208 |
| A4V9K4 | Tetracycline repressor | Salmonella enterica | 208 |
| A8R6K3 | Tetracycline repressor protein | Salmonella enterica subsp. enterica serovar Choleraesuis | 208 |
| Q573N4 | Tetracycline repressor protein | uncultured bacterium | 208 |
| Q7BQ37 | TetR | Shigella flexneri | 208 |
| Q9S455 | TetR | Salmonella typhi | 208 |
| A4IUI5 | Tetracycline repressor protein R, class B | Yersinia ruckeri | 207 |
| Q1A2K5 | Tetracycline resistance repressor protein | E. coli | 207 |
| Q6MXH5 | TetR class B from transposon tn10 | Serratia marcescens | 207 |
| Q79VX4 | TetR protein | Salmonella typhimurium | 207 |
| Q7AZW7 | Tet repressor protein | Pasteurella aerogenes | 207 |
| Q7AK84 | Repressor of tet operon | Plasmid R100 | 207 |
| Q6QR72 | Tetracycline repressor protein | E. coli | 208 |
| Q93F26 | Tet repressor | Shigella flexneri 2a | 208 |
| Q8L0M9 | Putative tetracycline repressor protein | Neisseria meningitidis | 205 |

These protein sequences can be used as sources for sequence diversity for protein design and/or directed evolution of the ligand binding domain. Further, these protein sequences can be used as sources for operator binding domains for chimeric repressor proteins, or for design and/or evolution of the operator binding domain.

The properties, domains, motifs and function of tetracycline repressors are well known, as are standard techniques and assays to evaluate any derived repressor comprising one or more amino acid substitutions. The structure of the class D TetR protein comprises 10 alpha helices with connecting loops and turns. The 3 N-terminal helices form the DNA-binding HTH domain, which has an inverse orientation as compared to HTH motifs in other DNA-binding proteins. The core of the protein, formed by helices 5-10, comprises the dimerization interface domain, and for each monomer comprises the binding pocket for ligand/effector and divalent cation cofactor (Kisker et al. (1995) *J Mol Biol* 247:260-180; Orth et al. (2000) *Nat Struct Biol* 7:215-219). Any amino acid change may comprise a non-conservative or conservative amino acid substitution. Conservative substitutions generally refer to exchanging one amino acid with another having similar chemical and/or structural properties (see, e.g., Dayhoff et al. (1978) Atlas of Protein Sequence and Structure, Natl Biomed Res Found, Washington, D.C.). Different clustering of amino acids by similarity have been developed depending on the property evaluated, such as acidic vs. basic, polar vs. non-polar, amphipathic and the like and be used when evaluating the possible effect of any substitution or combination of substitutions.

Numerous variants of TetR have been identified and/or derived and extensively studied. In the context of the tetracycline repressor system, the effects of various mutations, modifications and/or combinations thereof have been used to extensively characterize and/or modify the properties of tetracycline repressors, such as cofactor binding, ligand binding constants, kinetics and dissociation constants, operator binding sequence constraints, cooperativity, binding constants, kinetics and dissociation constants and fusion protein activities and properties. Variants include TetR variants with a reverse phenotype of binding the operator sequence in the presence of tetracycline or an analog thereof, variants having altered operator binding properties, variants having altered operator sequence specificity and variants having altered ligand specificity and fusion proteins. See, for example, Isackson and Bertrand (1985) *Proc Natl Acad Sci USA* 82:6226-6230; Smith and Bertrand (1988) *J Mol Biol* 203: 949-959; Altschmied et al. (1988) *EMBO J* 7:4011-4017; Wissmann et al. (1991) *EMBO J* 10:4145-4152; Baumeister et al. (1992) *J Mol Biol* 226:1257-1270; Baumeister et al. (1992) *Proteins* 14:168-177; Gossen and Bujard (1992) *Proc Natl Acad Sci USA* 89:5547-5551; Wasylewski et al. (1996) *J Protein Chem* 15:45-58; Berens et al. (1997) *J Biol Chem* 272:6936-6942; Baron et al. (1997) *Nucl Acids Res* 25:2723-2729; Helbl and Hillen (1998) *J Mol Biol* 276:313-318; Urlinger et al. (2000) *Proc Natl Acad Sci USA* 97:7963-7968; Kamionka et al. (2004) *Nucl Acids Res* 32:842-847; Bertram et al. (2004) *J Mol Microbiol Biotechnol* 8:104-110; Scholz et al. (2003) *J Mol Biol* 329: 217-227; and patent publication US 2003/0186281.

The three-dimensional structures of tetracycline repressors, and tetracycline repressor variants, coupled to ligand and/or co-factor(s), and bound to operator sequence are known (see, for example, Kisker et al. (1995) *J Mol Biol* 247:260-280; Orth et al. (1998) *J Mol Biol* 279:439-447; Orth et al. (1999) *Biochemistry* 38:191-198; Orth et al. (2000) *Nat Struct Biol* 7:215-219; Luckner et al. (2007) *J Mol Biol* 368: 780-790) providing extremely well characterized structure(s), identification of domains and individual amino acids associated with various functions and binding properties, and predictive model(s) for the potential effects of any amino acid substitution(s), as well as the possible structural bases for the phenotype(s) of known tetracycline repressor mutants. One example of percent sequence identity observed within tetracycline repressor family members is shown below.

| % polypeptide sequence identity between TetR family members | | | | | |
|---|---|---|---|---|---|
| TetR Class | A (P03038) | E (P21337) | B (P04483) | D (P0ACT4) | H (P51561) |
| A (P03038) | 100 | 44 | 51 | 48 | 50 |
| E (P21337) |  | 100 | 51 | 49 | 50 |
| B (P04483) |  |  | 100 | 64 | 64 |
| D (P0ACT4) |  |  |  | 100 | 58 |
| H (P51561) |  |  |  |  | 100 |

Examples

Example 1

Evolution of TetR for Recognition by sulfonylurea Compounds

A. Computational Modeling

The 3-D crystal structures of the class D tetracycline repressor (isolated from *E. coli*; TET-bound dimer, 1 DU7 (Orth et al. (2000) *Nat Struct Biol* 7:215-219); and DNA-bound dimer, 1QPI (Orth et al. (2000) *Nat Struct Biol* 7:215-219)), were used as the design scaffold for computational replacement of the tetracycline (TET) molecule by the thifensulfuron-methyl (Ts, Harmony®) molecule in the ligand binding pocket. TET and sulfonylureas (SUs) are generally similar in size and have aromatic ring-based structures with hydrogen bond donors and acceptors, potentially allowing SU binding to a mutated TetR. However, there are notable differences between the tetracycline family and SU family of molecules. TET is internally rigid and fairly flat, with one highly-hydrogen-bonding face with hydroxyls and ketones, log P~-0.3. Sulfonylureas (SUs) are more highly flexible and aromatic, with a core sulfonyl-urea moiety typically connecting a substituted benzene, pyridine, or thiophene (as in the case of Harmony®) on one side with a substituted pyrimidine or 1,3,5-triazine on the other side. Although having different functional groups, the log P of Harmony® is similar (~0.02 at pH 7) to that of tet. A best-posed Harmony® molecule was positioned by molecular modeling in the TetR binding pocket in silico (FIG. 1). Based on this model, seventeen amino acid residue positions (60, 64, 82, 86, 100, 104, 105, 113, 116, 134, 135, 138 and 139 from monomer A and positions 147, 151, 174 and 177 from monomer B, using TetR(B) numbering) were determined to be in sufficiently close proximity to a docked Harmony® as to be recruited into a binding surface. Computational side-chain optimization was employed to design sets of amino acids at each of the 17 positions deemed to be most compatible with SU binding. This resulted in a library with (4, 5, 4, 4, 5, 3, 8, 11, 10, 10, 8, 8, 7, 9, 6, 7 and 5) amino acids at the 17 positions, for a total designed library size of $4\times10^{13}$. The choice of amino acids at the library positions was dictated by steric and physicochemical considerations to fit ligand docking into the ligand pocket.

The wild type class B TetR from Tn10 was chosen as the starting molecule for generation of shuffling derivatives (SEQ ID NO: 2). It is slightly different than the sequence used in computational design (P0ACT4, class D, for which the high-resolution crystal structure 1DU7 is available), but only subtly affects ligand binding. A comparison of TetR(D) (SEQ ID NO: 401) and TetR(B) (SEQ ID NO: 2) is shown below with positions involved in tet recognition and binding in bold:

1 . . . . . .
1DU7 SRLNRESVIDAALELLNETGIDGLTTRKLAQKLGIEQPTLYWHVKNKRALLDALAVEI
Class B MGSRLDKSKVINSALELLNEVGIEGLTTRKLAQKLGVEQPTLYWHVKNKRALLDALAIEM 61 . . . . . .
1DU7 LARHHDYSLPAAGESWQSFLRNNAMSFRRALLRYRDGAKVHLGTRPDEKQYDTVETQLRF
Class B LDRHHTHFCPLEGESWQDFLRNNAKSFRCALLSHRDGAKVHLGTRPTEKQYETLENQLAF 121 . . . . . .
1DU7 MTENGFSLRDGLYAISAVSHFTLGAVLEQQEHTAALTDRPAAPDENLPPLLREALQIMDS
Class B LCQQGFSLENALYALSAVGHFTLGCVLEDQEHQVAKEERETPTTDSMPPLLRQAIELFDH 181 . . 208
1DU7 DDGEQAFLHGLESLIRGFEVQLTALLQIV
Class B QGAEPAFLFGLELIICGLEKQLKCESGS- The starting polynucleotide used to express TetR was synthesized commercially and restriction sites were added for functionality in library construction and further manipulation (DNA2.0, Menlo Park, Calif., USA). Added restriction sites include an NcoI site at the 5' end, a SacI site 5' of the ligand binding domain (LBD) and an AscI site following the stop codon. This allows library construction to be localized in a ~480 by DNA segment containing the ligand binding region to avoid inadvertent mutations in the other regions, such as the DNA binding domain. The synthetic gene was operably linked downstream of an arabinose inducible promoter, $P_{BAD}$, using Ncoi/AscI to create TetR expression vector pVER7314 (FIG. 2). The addition of the NcoI site at the 5' end of the coding region resulted in the insertion of a glycine after the N-terminal methionine at amino acid position one (SEQ ID NO: 2). This sequence was used as the wild type TetR control in all assays unless otherwise noted, and observed activity was equivalent to TetR without the serine insertion (SEQ ID NO: 1). However, all references to amino acid positions and changes designed and observed use the amino acid numbering of wild type TetR(B) (207 aa) e.g., SEQ ID NO: 1.

B. Library Design

Due to the large number of designed substitutions at many positions in close proximity with one another the computed library (Table 1, Designed Library) was not easily encodable with a small number of degenerate codons. This is particularly evident in sequence regions such as amino acids 134, 135, 138 and 139, which could reasonably be encoded by a single primer. For this reason, the sequence library fabricated and tested in the lab featured the designed amino acid set at 6/17 positions, slightly enlarged at 1/17 positions, and fully degenerate (NNK codon) at 10/17 positions (Table 1). This resulted in much higher predicted sequence diversity, a total of $3\times10^{19}$ sequences.

TABLE 1

| Residue | WT residue | Designed Library | Actual Library |
|---|---|---|---|
| 60 | L | A L K M | A L K M |
| 64 | H | A N Q H L | A N Q H L |
| 82 | N | A N S T | A N S T |
| 86 | F | M F W Y | M F W Y |
| 100 | H | H M F W Y | All 20 aa's |
| 104 | R | A R G | A R G |
| 105 | P | A N D G P S T V | All 20 aa's |
| 113 | L | A R N D Q E K M S T V | A R N D Q E K M S T V I P L G H |

TABLE 1-continued

| Residue | WT residue | Designed Library | Actual Library |
|---|---|---|---|
| 116 | Q | A R N Q E I K M T V | All 20 aa's |
| 134 | L | A R I L K M F W Y V | All 20 aa's |
| 135 | S | A R N Q H K S T | A R N Q H K S T |
| 138 | G | A H K M F S Y W | All 20 aa's |
| 139 | H | A R Q H L K Y | All 20 aa's |
| 147 | E | A R Q E H L K M Y | All 20 aa's |
| 151 | H | A Q H K I L | All 20 aa's |
| 174 | I | A R Q E L K M | All 20 aa's |
| 177 | F | A R L K M | All 20 aa's |

The constructed library, termed 'L1', was encoded with a total of fifty oligonucleotides (Table 2) rather than the thousands that would have been required to completely specify the designed target library. Table 2 also includes two PCR amplification primers.

TABLE 2

| Oligo ID | Oligo Sequence | SEQ ID |
|---|---|---|
| L1:01 | TATTGGCATGTAAAAAATAAGCGAGCTCTGCTCGACGCCTTA | 833 |
| L1:02 | GCCATTGAGATGAWGGATAGGCACCWGACTCACTTTGCCCT | 834 |
| L1:03 | GCCATTGAGATGAWGGATAGGCACMATACTCACTTTGCCCT | 835 |
| L1:04 | GCCATTGAGATGAWGGATAGGCACGCGACTCACTTTGCCCT | 836 |
| L1:05 | GCCATTGAGATGACGGATAGGCACCWGACTCACTTTGCCCT | 837 |
| L1:06 | GCCATTGAGATGACGGATAGGCACMATACTCACTTTGCCCT | 838 |
| L1:07 | GCCATTGAGATGACGGATAGGCACGCGACTCACTTTGCCCT | 839 |
| L1:08 | GCCATTGAGATGATGGATAGGCACCWGACTCACTTTGCCCT | 840 |
| L1:09 | GCCATTGAGATGATGGATAGGCACMATACTCACTTTGCCCT | 841 |
| L1:10 | GCCATTGAGATGATGGATAGGCACGCGACTCACTTTGCCCT | 842 |
| L1:11 | TTAGAAGGGGAAAGCTGGCAAGATTTTTTACGTAATAACGCT | 843 |
| L1:12 | TTAGAAGGGGAAAGCTGGCAAGATTTTTTACGTAATDCTGCT | 844 |
| L1:13 | AAAAGTTWTAGATGTGCTTTACTAAGTCATCGCGATGGAGCA | 845 |
| L1:14 | AAAAGTTGGAGATGTGCTTTACTAAGTCATCGCGATGGAGCA | 846 |
| L1:15 | AAAAGTATGAGATGTGCTTTACTAAGTCATCGCGATGGAGCA | 847 |
| L1:16 | AAAGTANNKTTAGGTACAGCGNNKACAGAAAAACAGTATGAA | 848 |
| L1:17 | AAAGTANNKTTAGGTACASGCNNKACAGAAAAACAGTATGAA | 849 |
| L1:18 | ACTVNSGAAAATNNKTTAGCCTTTTTATGCCAACAAGGTTTT | 850 |
| L1:19 | TCACTAGAGAATGCATTATATGCANNSRCCGCTGTGNNKNNK | 851 |
| L1:20 | TCACTAGAGAATGCATTATATGCANNSMGCGCTGTGNNKNNK | 852 |
| L1:21 | TCACTAGAGAATGCATTATATGCANNSMAKGCTGTGNNKNNK | 853 |
| L1:22 | TTTACTTTAGGTTGCGTATTGNNKGATCAAGAGNNKCAAGTC | 854 |
| L1:23 | GCTAAAGAAGAAAGGGAAACACCTACTACTGATAGTATGCCG | 855 |
| L1:24 | CCATTATTACGACAAGCTNNKGAATTANNKGATCACCAAGGT | 856 |
| L1:25 | GCAGAGCCAGCCTTCTTATTCGGCCTTGAATTGATCATATGC | 857 |
| L1:26 | GGATTAGAAAAACAACTTAAATGTGAAAGTGGGTCTTAAGGC | 858 |
| L1:27 | CCTATCCWTCATCTCAATGGCTAAGGCGTCGAGCAGAGCTCG | 859 |
| L1:28 | CCTATCCGCCATCTCAATGGCTAAGGCGTCGAGCAGAGCTCG | 860 |
| L1:29 | CCTATCCAGCATCTCAATGGCTAAGGCGTCGAGCAGAGCTCG | 861 |
| L1:30 | TTGCCAGCTTTCCCCTTCTAAAGGGCAAAAGTGAGTCWGGTG | 862 |
| L1:31 | TTGCCAGCTTTCCCCTTCTAAAGGGCAAAAGTGAGTATKGTG | 863 |
| L1:32 | TTGCCAGCTTTCCCCTTCTAAAGGGCAAAAGTGAGTCGCGTG | 864 |
| L1:33 | TAAAGCACATCTAWAACTTTTAGCGTTATTACGTAAAAAATC | 865 |
| L1:34 | TAAAGCACATCTCCAACTTTTAGCGTTATTACGTAAAAAATC | 866 |
| L1:35 | TAAAGCACATCTCATACTTTTAGCGTTATTACGTAAAAAATC | 867 |
| L1:36 | TAAAGCACATCTAWAACTTTTAGCAGHATTACGTAAAAAATC | 868 |
| L1:37 | TAAAGCACATCTCCAACTTTTAGCAGHATTACGTAAAAAATC | 869 |
| L1:38 | TAAAGCACATCTCATACTTTTAGCAGHATTACGTAAAAAATC | 870 |
| L1:39 | CGCTGTACCTAAMNNTACTTTTGCTCCATCGCGATGACTTAG | 871 |
| L1:40 | GCSTGTACCTAAMNNTACTTTTGCTCCATCGCGATGACTTAG | 872 |
| L1:41 | GGCTAAMNNATTTTCSNBAGTTTCATACTGTTTTTCTGTMNN | 873 |
| L1:42 | ATATAATGCATTCTCTAGTGAAAAACCTTGTTGGCATAAAAA | 874 |
| L1:43 | CAATACGCAACCTAAAGTAAAMNNMNNCACAGCGGYSNNTGC | 875 |
| L1:44 | CAATACGCAACCTAAAGTAAAMNNMNNCACAGCGCKSNNTGC | 876 |

TABLE 2-continued

| Oligo ID | Oligo Sequence | SEQ ID |
|---|---|---|
| L1:45 | CAATACGCAACCTAAAGTAAAMNNMNNCACAGCMTKSNNTGC | 877 |
| L1:46 | TGTTTCCCTTTCTTCTTTAGCGACTTGMNNCTCTTGATCMNN | 878 |
| L1:47 | MNNAGCTTGTCGTAATAATGGCGGCATACTATCAGTAGTAGG | 879 |
| L1:48 | GAATAAGAAGGCTGGCTCTGCACCTTGGTGATCMNNTAATTC | 880 |
| L1:49 | TTTAAGTTGTTTTTCTAATCCGCATATGATCAATTCAAGGCC | 881 |
| L1:50 | GGGAACTTCGGCGCGCCTTAAGACCCACTTTCACA | 882 |
| L1:5' | CATGTAAAAAATAAGCGAGCTCTG | 883 |
| L1:3' | GGGAACTTCGGCGCGCCTTAAGAC | 884 |

Assembly of the 'L1' oligos was carried out by overlap extension (Ness, et al., (2002) *Nat Biotech* 20:1251-1255) to generate a PCR fragment bordered by SacI/AscI restriction sites. Conditions for assembly of all library fragments were as follows: oligonucleotides representing the library are normalized to a concentration of 10 µM and then equal volumes mixed to create a 10 µM pool. PCR amplification of library fragments was performed in six identical 25 µl reactions containing: 1 M pooled library oligos; 0.5 µM of each rescue primer: L1:5' and L1:3' and 200 M dNTP's in a Herculase II directed reaction (Stratagene, La Jolla, Calif., USA). Conditions for PCR were 98° C. for 1 min (initial denature), followed by 25 cycles of 95° C. denature for 20 seconds, annealing for 45 seconds between 45° C. and 55° C. (gradient), then extending the template for 30 seconds at 72° C. A final extension of 72° C. for 5 minutes completes the reaction. Wild type TetR(B) is excised from the $P_{BAD}$-tetR expression vector pVER7314 by digestion with SacI/AscI. The pVER7314 backbone fragment is treated with calf intestinal phosphatase and purified, then the fully extended library fragment pool (~500 bp) digested with SacI/AscI restriction enzymes are inserted to generate the L1 plasmid library. Approximately 50 random clones from library L1 were sequenced and the information compiled for quality control purposes. The results indicated that nearly all amino acids targeted in the diversity set were represented (data not shown). Sequencing revealed that 17% of the sequences contained stop codons. This is less than the predicted 27% (e.g., 10 positions having 1/32 codons be a stop codon, $1-(31/32)^{10}$~27%). Additionally, sequence analysis showed that 13% of the clones had frame shifts due to mistakes in the overlap extension process. Thus, overall approximately 30% of the library consisted of clones encoding truncated polypeptides.

C. Screen Set Up

In order to test the library for rare clones reacting to thifensulfuron-methyl (Ts) a sensitive *E. coli* based genetic screen was developed. The screen is a modification of an established assay system (Wissmann et al. (1991) *Genetics* 128:225-232). The screen consists of two parts: a repressor pre-screen followed by an induction screen. For this purpose an *E. coli* strain was developed having both functionalities. For the repressor prescreen a genetic cascade was developed whereby an nptIII gene encoding kanamycin resistance is under the control of a lac promoter. The lac promoter is repressed by the Lac repressor encoded by lacI, whose expression is in turn controlled by the tet promoter (PtetR). The tet promoter is repressed by TetR which blocks LacI production and thus ultimately enables kanamycin resistance to be expressed.

Since the tet regulon has bivalent promoters, one promoter for tetR and one promoter for tetA, the same strain was engineered with the *E. coli* lacZ gene encoding enzyme reporter β-galactosidase under control of the tetA promoter (PtetA). The dual regulon encoding both lacI and lacZ was then bordered by strong transcriptional terminators: the *E. coli* RNA ribosomal operon terminator rrnB T1-T2 (Ghosh et al. (1991) *J Mol Biol* 222:59-66) and the *E. coli* RNA polymerase subunit C terminator rpoC, such that spurious transcripts read in the direction of either tet promoter would not interfere with expression of any other transcript. In the presence of functional TetR, the strain exhibits a lac⁻ phenotype and colonies can be easily scored for induction by novel chemistry with X-gal, wherein induction gives increased blue colony color. In addition, induction with novel chemistry in liquid cultures can be measured quantitatively by employing β-galactosidase enzyme assays with either colorimetric or fluorimetric substrates.

A further refinement of the host strain is that the to/C locus was knocked out with the incoming Plac-nptIII reporter. This was done to obtain better penetration of SU compounds into *E. coli* (Robert LaRossa—DuPont: personal communication). A strong transcriptional terminator, T22 from *S. typhimurium* phage P22, was placed upstream of the lac promoter to prevent unregulated leaky expression of the conditional kanamycin resistance marker. The name of the final engineered strain is *E. coli* KM3.

The population of shuffled tetR LBD's was cloned into an Ap'/ColE1 based vector pVER7314 behind the $P_{BAD}$ promoter. This was designed to enable fine control of TetR expression by variation of arabinose concentrations in the growth medium (Guzman et al. (1995) *J Bacteriol* 177:4121-4130). Despite being under the control of the $P_{BAD}$ promoter, TetR protein is expressed at a sufficient level in the absence of added arabinose to enable selection for kanamycin resistance in strain KM3. Nevertheless, expression can be increased by addition of arabinose, for example, if a change in assay stringency is desired.

D. Library Screening

Figure 3:
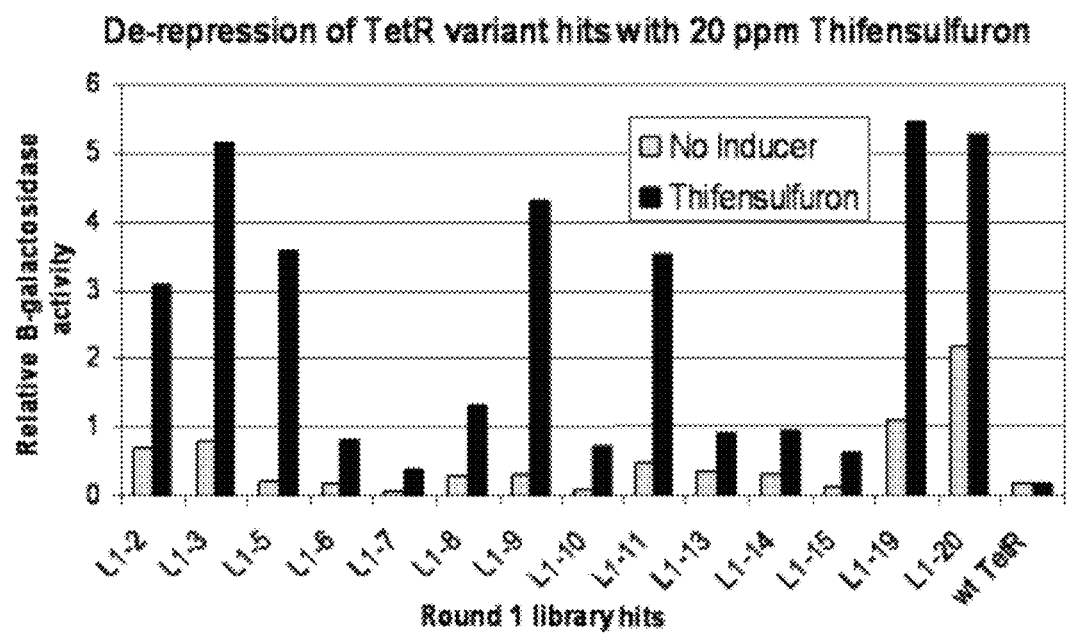
FIG. 3. Response of library 1 hits to 20 μg/ml thifensulfuron-methyl (Ts). *E. coli* KM3 cells harboring putative tetR hits L1-1 through L1-20 or wt tetR were replica plated onto M9 assay medium +/−20 μg/ml Ts, then incubated at 30° C. until blue/white colony discrimination was evident. At this time colonies were imaged and relative β-galactosidase activity determined based on degree of blue colony color.

Following assembly of L1 oligos and capture in vector pVER7314, the resulting library was transformed into *E. coli* strain KM3 and plated on LB containing 50 µg/ml carbenicillin to select for library plasmids, and 60 µg/ml kanamycin to select for the active repressor population in the absence of target ligand ("apo-repressors"). DNA sequence analysis of this selected population indicated that this step highly enriched several library positions, suggesting that few amino acid combinations in the ligand binding domain lead to a conformation compatible with DNA binding by the N-terminal domain. In addition, this step eliminated clones with premature stop codons and or frame shift mutations. Subsequently, these apo-repressor sequences were screened for alteration in repressor activity in the presence of Harmony® (Ts). This was done by replica plating the Km$^r$ pre-selected population from liquid cultures in 384-well format onto M9 agar containing 0.1% glycerol as carbon source, 0.04% casamino acids (to prevent branched chain amino acid starvation caused by sulfonylurea application), 50 µg/ml carbenicillin for plasmid maintenance, 0.004% X-gal to detect galactosidase activity, and +/−SU inducer Ts at 20 µg/ml. Initial hits were identified from a population of nearly 20,000 colonies screened for response to Ts following incubation at 30° C. for 2 days. Fourteen putative 'hits' identified were then re-tested under the same conditions but in 96-well format (FIG. 3).

DNA sequence analysis revealed that clones L1-3 and L1-19 are identical and that the most intensely responding hits (L-2, -3(19), -5, -9, -11 and -20) had significant enrichment at several library positions, indicating an involvement in ligand interaction, directly or indirectly. The same library was then re-screened to identify a further 10 hits to bring the total number of clones to 23.

All 23 putative hits were subsequently screened in the same plate assay format with a panel of nine sulfonylurea (SU) compounds registered for commercial use (Table 3), wherein 11 hits were found to respond significantly to other SU ligands (Table 4). For this experiment, *E. coli* clones encoding L1 hits or wt TetR (SEQ ID NO: 2) were arrayed in 96-well format and stamped onto M9 X-gal assay media with or without test SU compounds at 20 μg/ml. Following 48 hrs growth at 30° C. the plates were digitally imaged and the colony color intensity converted to relative values of β-galactosidase activity. Inducers used: thifensulfuron (Ts), metsulfuron (Ms), sulfometuron (Sm), ethametsulfuron (Es), tribenuron (Tb), chlorimuron (Ci), nicosulfuron (Ns), rimsulfuron (Rs), chlorsulfuron (Cs) at 20 ppm and anhydrotetracycline (atc) as the positive control at 0.4 μM for induction of wt TetR. Surprisingly, some sulfonylurea compounds, particularly chlorimuron, ethametsulfuron, and chlorsulfuron were more potent activators than the starting ligand Harmony®.

TABLE 3

| | SU Compound | |
| --- | --- | --- |
| Common Name | Product Name | Commercial Use |
| Thifensulfuron-methyl (Ts) | Harmony ® | Cereals, corn, soybean |
| Metsulfuron-methyl (Ms) | Ally ® | Cereals, pasture |
| Sulfometuron-methyl (Sm) | Oust ® | Vegetation management |
| Ethametsulfuron-methyl (Es) | Muster ® | Canola |
| Tribenuron-methyl (Tb) | Express ® | Cereal, sunflower |
| Chlorimuron-ethyl (Ci) | Classic ® | Soybean |
| Nicosulfuron (Ns) | Accent ® | Corn |
| Rimsulfuron (Rs) | Matrix ® | Corn, tomato, potato |
| Chlorsulfuron (Cs) | Glean ® | Cereals |

TABLE 4

| | Inducer | | | | | | | | | |
| --- | --- | --- | --- | --- | --- | --- | --- | --- | --- | --- |
| clone | None | Ts | Ms | Sm | Es | Tb | Ci | Ns | Rs | Cs | atc |
| L1-2 | 1.0 | 1.6 | 1.9 | 4.7 | 5.8 | 1.7 | 13.6 | 1.3 | 1.3 | 4.1 | 1.2 |
| L1-7 | 0.0 | 0.1 | 0.2 | 6.4 | 0.1 | 0.2 | 16.5 | 0.1 | 0.2 | 3.1 | 0.0 |
| L1-9 | 0.3 | 1.1 | 1.2 | 0.6 | 11.8 | 0.4 | 9.8 | 0.3 | 0.4 | 23.6 | 0.3 |
| L1-20 | 1.4 | 2.6 | 12.4 | 6.0 | 15.0 | 2.6 | 13.5 | 1.6 | 2.0 | 22.0 | 2.0 |
| L1-22 | 0.1 | 0.0 | 0.1 | 17.2 | 0.3 | 0.3 | 10.4 | 0.2 | 0.1 | 0.2 | 0.0 |
| L1-24 | 0.1 | 0.3 | 0.4 | 3.1 | 0.2 | 1.6 | 22.1 | 0.3 | 0.3 | 3.3 | 0.1 |
| L1-28 | 0.0 | 0.1 | 18.8 | 1.1 | 0.8 | 0.3 | 14.6 | 0.1 | 0.2 | 5.8 | 0.0 |
| L1-29 | 0.0 | 0.0 | 13.5 | 2.7 | 1.7 | 0.3 | 20.9 | 0.1 | 0.1 | 15.8 | 0.0 |
| L1-31 | 0.3 | 0.9 | 0.5 | 0.9 | 13.7 | 0.1 | 1.1 | 0.5 | 0.4 | 1.4 | 0.4 |
| L1-38 | 9.5 | 16.7 | 14.7 | 18.3 | 14.8 | 15.8 | 15.3 | 8.7 | 9.5 | 14.0 | 6.4 |
| L1-44 | 0.2 | 1.9 | 2.9 | 0.4 | 2.4 | 0.4 | 6.7 | 0.4 | 0.3 | 12.0 | 0.2 |
| TetR | 0.0 | 0.0 | 0.0 | 0.1 | 0.0 | 0.1 | 0.1 | 0.1 | 0.1 | 0.0 | 25.0 |

The amino acid substitutions for these eleven top hits are summarized in Table 5. The sequences are compared to wild type TetR(B) and only positions having differences are shown using the numbering according to TetR(B) (e.g., SEQ ID NO: 1). A dash in the alignment indicates no change relative to wt TetR ligand binding domain.

TABLE 5

| | 60 | 64 | 82 | 86 | 100 | 104 | 105 | 113 | 116 | 134 | 135 | 138 | 139 | 147 | 151 | 164 | 174 | 177 | 203 | 205 |
| --- | --- | --- | --- | --- | --- | --- | --- | --- | --- | --- | --- | --- | --- | --- | --- | --- | --- | --- | --- | --- |
| TetR (B) | L | H | N | F | H | R | P | L | Q | L | S | G | H | E | H | D | I | F | C | S |
| L1-02 | — | A | — | — | C | A | V | M | I | R | R | I | A | W | Y | — | R | I | — | — |
| L1-07 | — | N | — | W | V | A | I | H | P | I | A | R | R | V | R | — | S | Q | — | R |
| L1-09 | — | A | — | M | C | G | F | A | S | M | Q | C | I | L | L | — | L | K | — | — |
| L1-20 | M | Q | — | M | F | A | W | V | L | — | N | A | T | W | K | — | H | G | S | — |
| L1-22 | M | — | T | Y | C | A | I | K | N | R | Q | R | V | F | M | — | S | L | S | — |
| L1-24 | — | N | S | M | L | A | V | T | S | I | R | R | T | V | R | — | K | L | — | — |
| L1-28 | — | A | — | M | W | A | W | P | V | S | R | V | T | T | K | — | W | L | — | — |
| L1-29 | M | Q | T | M | W | — | W | P | M | W | — | C | N | S | R | — | W | S | — | — |
| L1-31 | — | A | — | M | M | — | A | V | R | V | R | H | W | I | M | — | Y | Y | — | — |
| L1-38 | A | — | — | M | W | A | W | T | M | W | R | T | M | R | W | — | L | G | — | — |
| L1-44 | — | A | — | Y | Y | A | V | A | — | V | K | A | G | W | S | A | V | A | — | — |

The initial screenings of library 1 also detected library members having reverse repressor activity (SEQ ID NO: 1206-1213), wherein the polypeptide was bound to the operator in the presence of SU ligand. These hits showed β-galactosidase expression without SU ligand, which was substantially reduced upon addition of the ligand, for example thifensulfuron. These hits were subsequently screened in the same plate assay format as described above with the panel of nine sulfonylurea (SU) compounds registered for commercial use (Table 3), wherein 8 hits were found to respond significantly to other SU ligands (Table 6).

TABLE 6

| clone | Inducer | | | | | | | | | | |
|---|---|---|---|---|---|---|---|---|---|---|---|
| | Blank | Ts | Ms | Sm | Es | Tb | Ci | Ns | Rs | Cs | atc |
| L1-18 | 1.34 | 1.13 | 0.79 | 0.94 | 0.37 | 1.65 | 0.36 | 1.44 | 2.55 | 1.22 | 2.35 |
| L1-21 | 2.88 | 0.79 | 0.89 | 2.39 | 0.61 | 2.13 | 0.07 | 2.74 | 2.31 | 0.89 | 2.81 |
| L1-25 | 1.17 | 0.64 | 0.32 | 0.63 | 0.13 | 1.72 | 0.11 | 1.21 | 1.08 | 0.28 | 1.22 |
| L1-33 | 7.59 | 5.51 | 4.29 | 5.02 | 2.11 | 4.71 | 0.76 | 5.34 | 10.32 | 3.74 | 8.25 |
| L1-34 | 2.37 | 2.97 | 1.47 | 2.00 | 1.33 | 2.26 | 0.43 | 2.91 | 2.30 | 0.85 | 3.68 |
| L1-36 | 1.52 | 0.48 | 0.38 | 0.50 | 0.20 | 0.57 | 0.21 | 1.81 | 1.84 | 0.24 | 1.70 |
| L1-39 | 3.65 | 1.42 | 0.75 | 0.91 | 0.60 | 0.97 | 0.49 | 3.03 | 4.72 | 0.89 | 4.92 |
| L1-41 | 4.05 | 1.46 | 0.56 | 0.67 | 0.18 | 1.41 | 0.39 | 2.75 | 4.05 | 0.61 | 4.21 |
| TetR | 0.00 | 0.08 | 0.08 | 0.23 | 0.06 | 0.13 | 0.18 | 0.18 | 0.20 | 0.15 | 10.45 |

The amino acid substitutions for these eight reverse repressor hits (SEQ ID NO: 1206-1213 encoded by SEQ ID NO: 1214-1221) are summarized in Table 7. The sequences are compared to wild type TetR(B) and only positions having differences are shown using the numbering according to TetR (B) (e.g., SEQ ID NO: 1). A dash in the alignment indicates no change relative to wt TetR ligand binding domain.

TABLE 7

| Clone | 60 | 63 | 64 | 82 | 84 | 86 | 100 | 104 | 105 | 113 | 116 | 121 | 134 | 138 | 139 | 147 | 151 | 163 | 174 | 177 | 205 | 206 |
|---|---|---|---|---|---|---|---|---|---|---|---|---|---|---|---|---|---|---|---|---|---|---|
| TetR wt | L | H | H | N | K | F | H | R | P | L | Q | C | L | S | G | H | E | H | T | I | F | S | G |
| SU-TetR-18 | – | – | L | – | – | M | W | G | F | K | R | – | I | R | S | R | Q | P | – | V | – | – | E |
| SU-TetR-21 | – | – | A | – | – | – | C | A | G | – | C | – | R | – | V | C | F | M | – | A | L | – | – |
| SU-TetR-25 | – | – | A | T | – | M | L | A | T | – | L | Y | W | Q | W | R | I | T | – | V | K | T | – |
| SU-TetR-33 | – | – | A | N | – | M | Q | A | A | – | K | – | H | – | T | Q | R | G | – | R | R | – | – |
| SU-TetR-34 | A | – | N | A | R | M | Y | A | R | T | V | – | V | R | P | R | L | R | – | R | T | – | – |
| SU-TetR-36 | A | – | – | A | – | M | R | A | W | H | V | – | – | K | S | G | K | M | – | T | V | – | – |
| SU-TetR-39 | M | – | Q | T | – | Y | I | – | W | R | V | – | W | A | – | P | R | R | – | L | M | – | – |
| SU-TetR-41 | – | N | Q | – | – | W | M | – | N | A | G | – | C | R | W | T | D | T | S | M | K | – | – |

E. Correlation of First Round Shuffling Results with the Structural Model

Significant enrichment occurred at most library positions, where enrichment includes biases favoring particular amino acids and biases disfavoring particular amino acids. The initial screening involved two stages to identify both repressor and de-repressor functions. Enrichment occurred in both stages of screening. In the first stage, positions were enriched by the selection for "apo repressors', that is, proteins that repress gene transcription in the absence of ligand. In the second stage, positions were enriched by the selection for "activators", that is, proteins that allow gene transcription in the presence of ligand. Positions may be enriched by either selection criterion, by both criteria, or by neither. The first-round screening results for repressor activity are summarized below:

| | Amino Acid Bias Observed | | |
|---|---|---|---|
| Position | Apo repressor | SU Induction | Both |
| 60 | | L (not K) | |
| 64 | | Q, N (not L, A) | |
| 82 | N (not A, T) | A (not N, S) | |
| 86 | (not M) | M (not W) | |
| 100 | R (not K, Q) | C, W (not H, K, Q) | |

-continued

| | Amino Acid Bias Observed | | |
|---|---|---|---|
| Position | Apo repressor | SU Induction | Both |
| 104 | G | A | |
| 105 | C, G, L, V (not H, K) | L, W (not G, S) | L |

-continued

| | Amino Acid Bias Observed | | |
|---|---|---|---|
| Position | Apo repressor | SU Induction | Both |
| 113 | A (not G, P) | A, I (not D, G) | A |
| 116 | (not GL) | M, V (not A, R) | |
| 134 | M, S | I, R, W (not G) | |
| 135 | K, R (not H, S) | Q, R (not A, T) | R |
| 138 | (not T) | A, C, R, V (not L, P, Q, T) | |
| 139 | R (not H) | T (not L, P) | |
| 147 | (not A, C) | R, W (not A, S) | |
| 151 | R (not C, G, Q) | M, R (not V) | R |
| 174 | V (not L, R) | W (not F, L) | |
| 177 | T (not S) | K, L (not P, T) | |

Enrichment at the activator level was consistent with the computational model of SU binding: sterically-selected positions (e.g., 60, 86, 104, 105, 113, 138, 139) occurred in closest proximity to the modeled ligand, electrostatically-selected positions (e.g., 135, 147, 151, 177) occurred near the modeled sulfonyl moiety, and aromatically-selected positions (e.g., 100, 105, 147, 174) were modeled to form aromatic stacking interactions with the planar ring structures in thifensulfuron. Enrichment at the apo repressor level was consistent with the predicted mode of DNA binding: enriched positions were modeled to be capable of modulating association of the repressor protein with the DNA operator sequence.

In the case of the SU induction screen, enrichment was evidenced by both over-represented amino acids that were modeled to form favorable interactions with the ligand (e.g., methionine (M) and valine (V) at position 116 were modeled to pack well against the triazine ring of the SU molecule) and by under-represented amino acids that were modeled to produce unfavorable interactions with the ligand (e.g., tryptophan ('W') at position 86 was modeled to be too large to accommodate ligand in binding pocket). In the case of the apo repressor, enrichment took the form both of over-represented amino acids that were modeled to give rise to a functional repressor conformation capable of binding the DNA operator sequence in the absence of ligand (e.g., alanine ('A') at position 113, which maintains the structural integrity of this α-helix) and of under-represented amino acids that were modeled to disrupt the actively repressing conformation in the absence of ligand (e.g., glycine and proline (R) at position 113, which reduce the structural integrity of this α-helix).

Results from different rounds of screening and selection may produce altered enrichments at some positions, as the result of interactions with other amino acids selected, or with the small molecule. Enriched sequences only demonstrate that side-chains can contribute to active inducers, and do not rule out any amino acids. Thus, selected hits are likely to represent only a subset of possible active sequences. A variety of possible ligand-binding modes and protein interactions may be possible for the same SU molecule, and thus enrichment of several types of side-chains at a specific position may represent multiple populations of active proteins. Computational modeling of the enriched sequences is useful insofar as it enables the prioritization of amino acid diversity for rounds of screening and selection.

Altogether, these enrichment results support the overall computational model and facilitated additional design. Several positions which were constructed as fully-degenerate codons (all 20 amino acids) returned first-round screening results consistent with the suggested computational model. For example, computational modeling suggested that the aromatic side-chains W, Y and F at position 100 would favor SU binding. The first-round library was screened with a degenerate codon at this position, and the amino acids W, Y and F were significantly enriched. Designed libraries allow sequence diversity to be narrowed at library positions, with an emphasis on decreasing diversity at coupled positions such that fully degenerate codons may be avoided. Additionally, more positions could be recruited for diversification to achieve greater coverage of a higher-quality, more focused sequence library. This allows construction of a library with sufficiently few members to screen with good coverage, yet sufficient diversity to discover sequences with detectable activity. Such sequences may then be improved by introducing more diversity at library positions, with a screen or selection choosing optimal clones, independent of model predictions. In this way, the combination of computational modeling and directed evolution allows the generation of engineered sequences unlikely to be discovered by either technique separately.

F Second-Round Shuffling

The original library was designed to thifensulfuron, but once induction activity was established with other SU compounds having potentially better soil and in planta stability properties than the original ligand, the evolution process was re-directed towards these alternative ligands. Of particular interest were herbicides metsulfuron, sulfometuron, ethametsulfuron and chlorsulfuron. For this objective, parental clones L1-9, -22, -29 and -44 were chosen for further shuffling. Clone L1-9 has strong activity on both ethametsulfuron and chlorsulfuron; clone L1-22 has strong sulfometuron activity; clone L1-29 has moderate metsulfuron activity; and clone L1-44 has moderate activity on metsulfuron, ethametsulfuron and chlorsulfuron (Table 4). No clones found in the initial screen were exceptionally reactive to metsulfuron. These four clones were also chosen due to their relatively strong repressor activity, showing low β-gal background activity without inducer. Strong repressor activity is important for establishing a system which is both highly sensitive to the presence od inducer, and tightly off in the absence of inducer.

Based on the sequence information from parental clones L1-9, -22, -29 and -44, two second round libraries were designed, constructed and screened. The first library, L2, consisted of a 'family' shuffle whereby the amino acid diversity between the selected parental clones was varied using synthetic assembly of oligonucleotides to find clones improved in responsiveness to any of the four new target ligands. A summary of the diversity used and the resulting hit sequences for library L2 is shown in Table 8.

TABLE 8

| Clone | Amino acid residue position | | | | | | | | | | |
|---|---|---|---|---|---|---|---|---|---|---|---|
| | 60 | 64 | 82 | 86 | 100 | 104 | 105 | 113 | 116 | 134 | 135 |
| wt | L | H | N | F | H | R | P | L | Q | L | S |
| Parents | | | | | | | | | | | |
| L1-9 | — | A | — | M | C | G | F | A | S | M | Q |
| L1-22 | M | — | T | Y | C | A | I | K | N | R | Q |
| L1-29 | M | Q | T | M | W | — | W | P | M | W | — |
| L1-44 | — | A | — | Y | Y | A | V | A | — | V | K |
| Hits | | | | | | | | | | | |
| L2-2 | — | Q | — | M | C | — | F | K | — | V | — |
| L2-9 | M | Q | — | M | Y | — | W | A | — | W | — |
| L2-10 | — | A | — | M | W | G | W | K | M | M | — |
| L2-13 | — | Q | — | M | C | — | W | A | — | W | Q |

TABLE 8-continued

| Clone | 138 | 139 | 147 | 151 | 164 | 174 | 177 | 203 | Inducer preference |
|---|---|---|---|---|---|---|---|---|---|
| L2-14 | M | A | — | M | C | — | W | A | M | V | — |
| L2-18 | M | Q | T | M | W | — | W | A | — | M | — |
| L1-45 | A | Q | — | W | W | G | L | P | V | T | Q |
| Unselected frequency | random | random | random | random | W > C, Y | R >> G, A | W > V > I, F | random | random | random | S >> Q, K |

| | Amino acid residue position | | | | | | | | Inducer |
|---|---|---|---|---|---|---|---|---|---|
| Clone | 138 | 139 | 147 | 151 | 164 | 174 | 177 | 203 | preference |
| wt | G | H | E | H | D | I | F | C | atc |
| Parents | | | | | | | | | |
| L1-9 | C | I | L | L | — | L | K | — | 4, 9 (weak) |
| L1-22 | R | V | F | M | — | S | L | S | 3 |
| L1-29 | C | N | S | R | — | W | S | — | 9 (weak) |
| L1-44 | A | G | W | S | A | V | A | — | 9 (weak) |
| Hits | | | | | | | | | |
| L2-2 | R | I | W | M | — | W | L | — | 4 (inverse) |
| L2-9 | A | I | W | S | — | S | K | — | 9 (leaky) |
| L2-10 | R | I | L | L | — | W | K | — | 4 (leaky) |
| L2-13 | R | I | S | M | — | V | K | — | 9 |
| L2-14 | R | V | F | S | A | L | K | — | 9 |
| L2-18 | R | N | F | L | A | W | K | — | 9 |
| L1-45 | R | — | G | R | — | A | L | — | 3, 4 |
| Unselected frequency | A >> C, R | G, N > V > I | random | random | random | random | random | C >> S | |

The oligonucleotides used to construct the library are shown in Table 9. The L2 oligonucleotides were assembled, cloned and screened as per the protocol described for library L1 except that each ligand was tested at 2 ppm to increase the stringency of the assay, which is a 10-fold reduction from 1st round library screening concentration.

TABLE 9

| Oligo | Sequence | SEQ ID |
|---|---|---|
| L2:01 | TATTGGCATGTAAAAAATAAGCGAGCTCTGCTCGACGCCTTA | 885 |
| L2:02 | GCCATTGAGATGWTGGATAGGCACCASACTCACTTTTGCCCT | 886 |
| L2:03 | GCCATTGAGATGWTGGATAGGCACGCAACTCACTTTTGCCCT | 887 |
| L2:04 | TTAGAAGGGGAAAGCTGGCAAGATTTTTTACGTAATAMTGCT | 888 |
| L2:05 | AAAAGTTACAGATGTGCTTTACTAAGTCATCGCGATGGAGCA | 889 |
| L2:06 | AAAAGTATGAGATGTGCTTTACTAAGTCATCGCGATGGAGCA | 890 |
| L2:07 | AAAGTATRTTTAGGTACACGCDTCACAGAAAAACAGTATGAA | 891 |
| L2:08 | AAAGTATRTTTAGGTACACGCTGGACAGAAAAACAGTATGAA | 892 |
| L2:09 | AAAGTATRTTTAGGTACAGSTDTCACAGAAAAACAGTATGAA | 893 |
| L2:10 | AAAGTATRTTTAGGTACAGSTTGGACAGAAAAACAGTATGAA | 894 |
| L2:11 | AAAGTATGGTTAGGTACACGCDTCACAGAAAAACAGTATGAA | 895 |
| L2:12 | AAAGTATGGTTAGGTACACGCTGGACAGAAAAACAGTATGAA | 896 |
| L2:13 | AAAGTATGGTTAGGTACAGSTDTCACAGAAAAACAGTATGAA | 897 |
| L2:14 | AAAGTATGGTTAGGTACAGSTTGGACAGAAAAACAGTATGAA | 898 |
| L2:15 | ACTAAAGAAAATARCTTAGCCTTTTTATGCCAACAAGGTTTT | 899 |
| L2:16 | ACTAAAGAAAATCAATTAGCCTTTTTATGCCAACAAGGTTTT | 900 |
| L2:17 | ACTAAAGAAAATATGTTAGCCTTTTTATGCCAACAAGGTTTT | 901 |
| L2:18 | ACTSCTGAAAATARCTTAGCCTTTTTATGCCAACAAGGTTTT | 902 |
| L2:19 | ACTSCTGAAAATCAATTAGCCTTTTTATGCCAACAAGGTTTT | 903 |
| L2:20 | ACTSCTGAAAATATGTTAGCCTTTTTATGCCAACAAGGTTTT | 904 |
| L2:21 | TCACTAGAGAATGCATTATATGCARTGAGTGCTGTGGCTAWT | 905 |
| L2:22 | TCACTAGAGAATGCATTATATGCARTGAGTGCTGTGGCTGKT | 906 |
| L2:23 | TCACTAGAGAATGCATTATATGCARTGAGTGCTGTGYGCAWT | 907 |

TABLE 9-continued

| Oligo | Sequence | SEQ ID |
|---|---|---|
| L2:24 | TCACTAGAGAATGCATTATATGCARTGAGTGCTGTGYGCGKT | 908 |
| L2:25 | TCACTAGAGAATGCATTATATGCARTGMAAGCTGTGGCTAWT | 909 |
| L2:26 | TCACTAGAGAATGCATTATATGCARTGMAAGCTGTGGCTGKT | 910 |
| L2:27 | TCACTAGAGAATGCATTATATGCARTGMAAGCTGTGYGCAWT | 911 |
| L2:28 | TCACTAGAGAATGCATTATATGCARTGMAAGCTGTGYGCGKT | 912 |
| L2:29 | TCACTAGAGAATGCATTATATGCAWGGAGTGCTGTGGCTAWT | 913 |
| L2:30 | TCACTAGAGAATGCATTATATGCAWGGAGTGCTGTGGCTGKT | 914 |
| L2:31 | TCACTAGAGAATGCATTATATGCAWGGAGTGCTGTGYGCAWT | 915 |
| L2:32 | TCACTAGAGAATGCATTATATGCAWGGAGTGCTGTGYGCGKT | 916 |
| L2:33 | TCACTAGAGAATGCATTATATGCAWGGMAAGCTGTGGCTAWT | 917 |
| L2:34 | TCACTAGAGAATGCATTATATGCAWGGMAAGCTGTGGCTGKT | 918 |
| L2:35 | TCACTAGAGAATGCATTATATGCAWGGMAAGCTGTGYGCAWT | 919 |
| L2:36 | TCACTAGAGAATGCATTATATGCAWGGMAAGCTGTGYGCGKT | 920 |
| L2:37 | TTTACTTTAGGTTGCGTATTGTKGGATCAAGAGAGMCAAGTC | 921 |
| L2:38 | TTTACTTTAGGTTGCGTATTGTKGGATCAAGAGMTGCAAGTC | 922 |
| L2:39 | TTTACTTTAGGTTGCGTATTGTYTGATCAAGAGAGMCAAGTC | 923 |
| L2:40 | TTTACTTTAGGTTGCGTATTGTYTGATCAAGAGMTGCAAGTC | 924 |
| L2:41 | GCTAAAGAAGAAAGGGAAACACCTACTACTGMTAGTATGCCG | 925 |
| L2:42 | CCATTATTACGACAAGCTAGTGAATTATTGGATCACCAAGGT | 926 |
| L2:43 | CCATTATTACGACAAGCTAGTGAATTAKCAGATCACCAAGGT | 927 |
| L2:44 | CCATTATTACGACAAGCTAGTGAATTAAAGGATCACCAAGGT | 928 |
| L2:45 | CCATTATTACGACAAGCTTKGGAATTATTGGATCACCAAGGT | 929 |
| L2:46 | CCATTATTACGACAAGCTTKGGAATTAKCAGATCACCAAGGT | 930 |
| L2:47 | CCATTATTACGACAAGCTTKGGAATTAAAGGATCACCAAGGT | 931 |
| L2:48 | CCATTATTACGACAAGCTGTAGAATTATTGGATCACCAAGGT | 932 |
| L2:49 | CCATTATTACGACAAGCTGTAGAATTAKCAGATCACCAAGGT | 933 |
| L2:50 | CCATTATTACGACAAGCTGTAGAATTAAAGGATCACCAAGGT | 934 |
| L2:51 | GCAGAGCCAGCCTTCTTATTCGGCCTTGAATTGATCATATGC | 935 |
| L2:52 | GGATTAGAAAAACAACTTAAATSCGAAAGTGGGTCTTAA | 936 |
| L2:53 | CCTATCCAWCATCTCAATGGCTAAGGCGTCGAGCAGAGCTCG | 937 |
| L2:54 | TTGCCAGCTTTCCCCTTCTAAAGGGCAAAAGTGAGTSTGGTG | 938 |
| L2:55 | TTGCCAGCTTTCCCCTTCTAAAGGGCAAAAGTGAGTTGCGTG | 939 |
| L2:56 | TAAAGCACATCTGTAACTTTTAGCAKTATTACGTAAAAAATC | 940 |
| L2:57 | TAAAGCACATCTCATACTTTTAGCAKTATTACGTAAAAAATC | 941 |
| L2:58 | GCGTGTACCTAAAYATACTTTTGCTCCATCGCGATGACTTAG | 942 |
| L2:59 | ASCTGTACCTAAAYATACTTTTGCTCCATCGCGATGACTTAG | 943 |
| L2:60 | GCGTGTACCTAACCATACTTTTGCTCCATCGCGATGACTTAG | 944 |
| L2:61 | ASCTGTACCTAACCATACTTTTGCTCCATCGCGATGACTTAG | 945 |
| L2:62 | GGCTAAGYTATTTTCTTTAGTTTCATACTGTTTTTCTGTGAH | 946 |
| L2:63 | GGCTAATTGATTTTCTTTAGTTTCATACTGTTTTTCTGTGAH | 947 |
| L2:64 | GGCTAACATATTTTCTTTAGTTTCATACTGTTTTTCTGTGAH | 948 |
| L2:65 | GGCTAAGYTATTTTCAGSAGTTTCATACTGTTTTTCTGTGAH | 949 |
| L2:66 | GGCTAATTGATTTTCAGSAGTTTCATACTGTTTTTCTGTGAH | 950 |
| L2:67 | GGCTAACATATTTTCAGSAGTTTCATACTGTTTTTCTGTGAH | 951 |
| L2:68 | GGCTAAGYTATTTTCTTTAGTTTCATACTGTTTTTCTGTCCA | 952 |
| L2:69 | GGCTAATTGATTTTCTTTAGTTTCATACTGTTTTTCTGTCCA | 953 |
| L2:70 | GGCTAACATATTTTCTTTAGTTTCATACTGTTTTTCTGTCCA | 954 |
| L2:71 | GGCTAAGYTATTTTCAGSAGTTTCATACTGTTTTTCTGTCCA | 955 |
| L2:72 | GGCTAATTGATTTTCAGSAGTTTCATACTGTTTTTCTGTCCA | 956 |
| L2:73 | GGCTAACATATTTTCAGSAGTTTCATACTGTTTTTCTGTCCA | 957 |
| L2:74 | ATATAATGCATTCTCTAGTGAAAAACCTTGTTGGCATAAAAA | 958 |
| L2:75 | CAATACGCAACCTAAAGTAAAAWTAGCCACAGCACTCAYTGC | 959 |

TABLE 9-continued

| Oligo | Sequence | SEQ ID |
|---|---|---|
| L2:76 | CAATACGCAACCTAAAGTAAAAMCAGCCACAGCACTCAYTGC | 960 |
| L2:77 | CAATACGCAACCTAAAGTAAAAWTGCRCACAGCACTCAYTGC | 961 |
| L2:78 | CAATACGCAACCTAAAGTAAAAMCGCRCACAGCACTCAYTGC | 962 |
| L2:79 | CAATACGCAACCTAAAGTAAAAWTAGCCACAGCTTKCAYTGC | 963 |
| L2:80 | CAATACGCAACCTAAAGTAAAAMCAGCCACAGCTTKCAYTGC | 964 |
| L2:81 | CAATACGCAACCTAAAGTAAAAWTGCRCACAGCTTKCAYTGC | 965 |
| L2:82 | CAATACGCAACCTAAAGTAAAAMCGCRCACAGCTTKCAYTGC | 966 |
| L2:83 | CAATACGCAACCTAAAGTAAAAWTAGCCACAGCACTCCWTGC | 967 |
| L2:84 | CAATACGCAACCTAAAGTAAAAMCAGCCACAGCACTCCWTGC | 968 |
| L2:85 | CAATACGCAACCTAAAGTAAAAWTGCRCACAGCACTCCWTGC | 969 |
| L2:86 | CAATACGCAACCTAAAGTAAAAMCGCRCACAGCACTCCWTGC | 970 |
| L2:87 | CAATACGCAACCTAAAGTAAAAWTAGCCACAGCTTKCCWTGC | 971 |
| L2:88 | CAATACGCAACCTAAAGTAAAAMCAGCCACAGCTTKCCWTGC | 972 |
| L2:89 | CAATACGCAACCTAAAGTAAAAWTGCRCACAGCTTKCCWTGC | 973 |
| L2:90 | CAATACGCAACCTAAAGTAAAAMCGCRCACAGCTTKCCWTGC | 974 |
| L2:91 | TGTTTCCCTTTCTTCTTTAGCGACTTGKCTCTCTTGATCCMA | 975 |
| L2:92 | TGTTTCCCTTTCTTCTTTAGCGACTTGCAKCTCTTGATCCMA | 976 |
| L2:93 | TGTTTCCCTTTCTTCTTTAGCGACTTGKCTCTCTTGATCARA | 977 |
| L2:94 | TGTTTCCCTTTCTTCTTTAGCGACTTGCAKCTCTTGATCARA | 978 |
| L2:95 | ACTAGCTTGTCGTAATAATGGCGGCATACTAKCAGTAGTAGG | 979 |
| L2:96 | CMAAGCTTGTCGTAATAATGGCGGCATACTAKCAGTAGTAGG | 980 |
| L2:97 | TACAGCTTGTCGTAATAATGGCGGCATACTAKCAGTAGTAGG | 981 |
| L2:98 | GAATAAGAAGGCTGGCTCTGCACCTTGGTGATCCAATAATC | 982 |
| L2:99 | GAATAAGAAGGCTGGCTCTGCACCTTGGTGATCTGMTAATTC | 983 |
| L2:100 | GAATAAGAAGGCTGGCTCTGCACCTTGGTGATCCTTTAATTC | 984 |
| L2:101 | TTTAAGTTGTTTTTCTAATCCGCATATGATCAATTCAAGGCC | 985 |
| L2:102 | GGGAACTTCGGCGCGCCTTAAGACCCACTTTCGSA | 986 |

G. Screening Results for Library L2

Nearly 8,000 colonies arising from the repressor prescreen were subjected to the activation screen on M9 assay medium containing potential inducers ethametsulfuron, sulfometuron, metsulfuron or chlorsulfuron at 2 ppm. After 48 hours of incubation at 30° C. the plates were analyzed. Twelve putative hits from these plates were re-arrayed into 96-well format and retested on the same set of media (Table 10). Only clone L2-14 had a strong induction response and tight regulation to any of the inducers at this lower 2 ppm dose, wherein it had a strong response to Cs and low background without inducer. Clone L2-18 had a moderate response to this ligand and low background. Clone L2-9 also responded well to Cs, but had higher background activity without inducer. No isolates showed a significant response to metsulfuron. An unexpected observation was that parent clone L1-9 has sensitivity to 2 ppm Es. Sequence analysis of the hit clones from library 2 (Table 6) indicates that F86M, G138R and F177K were preferred substitutions in the responding hits. This is especially striking at position 138 where A is far over represented in the unselected population and yet five clones have R at this position while only one has alanine. R105W could also be important, but in the random sequence population W105 was already biased over C or Y.

TABLE 10

| | | Inducer | | | | |
|---|---|---|---|---|---|---|
| | Sample | No inducer | Ms | Sm | Es | Cs |
| L1 parents | L1-9 | 0.9 | 0.9 | 0.9 | 14.8 | 2.2 |
| | L1-22 | 0.2 | 0.2 | 1.8 | 0.2 | 0.2 |
| | L1-29 | 0.1 | 0.3 | 0.2 | 0.3 | 0.2 |
| | L1-44 | 0.6 | 0.5 | 0.6 | 1.0 | 1.9 |
| L2 hits | L2-9 | 2.2 | 4.2 | 6.3 | 5.0 | 14.0 |
| | L2-10 | 1.3 | 1.1 | 1.7 | 7.7 | 1.7 |
| | L2-13 | 1.8 | 1.9 | 2.4 | 2.0 | 8.4 |
| | L2-14 | 0.5 | 1.0 | 0.9 | 0.9 | 17.0 |
| | L2-18 | 0.3 | 0.1 | 0.2 | 0.3 | 4.6 |
| | TetR | 0.1 | 0.0 | 0.1 | 0.1 | 0.1 |

H. Second Round Library L4 Assembly

Another second round library, L4, was created from synthetic oligonucleotides using clone L1-9 as the template and injecting novel amino acid diversity into the sequence based on phylogenetic comparison of 34 TetR and related molecules. A multiple sequence alignment of SEQ ID NO: 1 and SEQ ID NO: 402-433 generated using GCG Seq Web PILEUP (Accelrys, San Diego, Calif.) under default parameters of gap weight=8, gap length weight=2, and the BLOSUM62 matrix is shown below:

```
                       1                                                    50
ZP_01558383    ~~~mkdtg.a rltrdtvmra aldllnevgi dglstrrlae rlgvqsptly
YP_772551      ~~~mkdts.t rltrdtvmra aldllnevgi dglstrrlae rlgvqsptly
YP_620166      ~~~mkdts.t rltrdtvlra alnlldevgi dglstrrlae rlgvqsptly
EAY62734       miemkdtg.a rltrdtvlra alnlldevgi dglstrrlae rlgvqsptly
YP_368094      ~~~mkdtg.a rltrdtvlra alellldevgi dglstrklae rlgvqsptly
AAP93923       ~mseknta.a rltretvlrg alallddigi dalstrrlaq hlgvqsptly
AAW66496       ~mskkdiapq rltreivlrt aldmlneegi dsittrklaq rlgiksptly
CAA24908       ~~~~~~~~~mt klqpntvira aldllnevgv dglttrklae rlgvqqpaly
P03038         ~~~~~~~~~mt klqpntvira aldllnevgv dglttrklae rlgvqqpaly
ABS19067       ~~~~~~~~~mi klqpntvirv aldllnevgv ealttrklak rlgvqqpaly
NP_387462      ~~~~~~~~~mn klqreavirt alellndvgm eglttrrlae rlgvqqpaly
NP_387455      ~~~~~~~~~mk klqreavirt alellndvgm eglttrrlae rlgvqqpaly
AAR96033       ~~~~~~~~~mn klqreavirt alellndvgm eglttrrlae rlgvqqpaly
NP_511232      ~~~~~~~~~mn klqreavirt alellndvgm eglttrrlae rlgvqqpaly
AAW83818       ~~~~~~~~~mt klqpntvira aldllnevgv dglttrklae rlgvqqpaly
AAD25094       ~~~~~~~~~mt kldkgtviaa alellnevgm dslttrklae rlkvqqpaly
ABO14708       ~~~~~~~~~~ ~~~~~~~~~~ ~~~~~~~~~~ ~~~~~~~~~~ ~~~~~~~~ly
P51560         ~~~~~~~~~mt kldkgtviaa glellnevgm dslttrklae rlkvqqpaly
AAD25537       ~~~~~~~~~mt kldkgtviaa alellnevgm dslttrklae rlrvqqpaly
YP_001220607   ~~~~~~~~~mt kldretviqa alellnevgv dnlttrklae rlkvqqpaly
YP_001370475   ~~~~mvsala klhrdaviqt alellnevge eglttrrlae rlgvqqpaly
P21337         ~~~~~~~~~ma rlslddvism altlldsegl eglttrklaq slkieqptly
AAA98409       ~~~~~~~~~ma rlslddvism altlldsegl eglttrklaq slkieqptly
CAC81917       ~~~~~~~~~ma rlslddvism altlldregl eglttrnvaq slkieqptly
P51561         ~~~~~~~~~ma kldkeqvidd alillnevgi eglttrnvaq kigveqptly
ZP_00132379    ~~~~~~~~~ma kldkeqvidn alillnevgi eglttrklaq kigveqptly
AAD12754       ~~~~~~~~~ma kldkeqvidn alillnevgm eglttrklaq klgveqptly
P04483         ~~~~~~~~~ms rldkskvins alellnevgi eglttrklaq klgveqptly
A26948         ~~~~~~~~~ms rldkskvins alellnevgi eglttrklaq klgveqptly
CAC80726       ~~~~~~~~mma rldkkrvies alallldevgm eglttrklaq klnieqpsly
P0ACT4         ~~~~~~~~~MA RLNRESVIDA ALELLNETGI DGLTTRKLAQ KLGIEQPTLY
ZP_01567051    ~~~~~~~~~ma kirrdeivda alalldeqgl dalttrrlaq rlgvesaaly
NP_824556      ~~~mvtqrsp kldkkqvvet alrllneagl dgltlraiak elnvqapaly
                      51                                                  100
ZP_01558383    whfrnkaell damaeaimle rhgaslprpg dawdawllen arsfrralla
YP_772551      whfrnkaell damaeaimle rhgaslprpg dtwdawllen argfrralla
YP_620166      whfrnkaell damaeaimle rhgeslprpg dvwdvwlaen arsfrralla
EAY62734       whfrnkaell damaeaimle rhgeslprpg dvwdvwlaen arsfrralla
YP_368094      whfrnkgell damaeaimle rhdaslprpg eawdawlldn arsfrralla
AAP93923       whfknkaell kamaetimld .hreevpadm p.wqawvtan ainfrralla
AAW66496       whfknksllm eamaetiine hhlvslpidg mtwqdwllan svsfrralla
CAA24908       whfrnkrall dalaeamlae nhstsvprad ddwrsfltgn arsfrqalla
P03038         whfrnkrall dalaeamlae nhthsvprad ddwrsflign arsfrqalla
ABS19067       whfrnkrall dalaeamlae nhthsvprvd ddwrsflign arsfrqalla
NP_387462      whfrnkrall dalaeamlti nhthstprdd ddwrsflkgn acsfrralla
NP_387455      whfrnkrall dalaeamlti nhthstprde ddwrsflkgn acsfrralla
AAR96033       whfknkrall dalaeamlti nhthstprdd ddwrsflkgn acsfrralla
NP_511232      whfknkrall dalaeamlti nhthstprdd ddwrsflkgn acsfrralla
AAW83818       whfrnkrall dalaeamlae nhthsvprad ddwrsflkgn acsfrralla
AAD25094       whfqnkrall dalaeamlae rhtrslpeen edwrvflken alsfrtalls
ABO14708       whfqnkrall dalaeamlae rhtrslpeen edwrvflken alsfrtalls
P51560         whfqnkrall dalpeamlre rhtrslpeen edwrvflken alsfrtalls
AAD25537       whfpskrall daleaamlte rhtrslpeen edwrvflken alsfrkalls
YP_001220607   whfrnkrall dalseamlek nhtrtvpqtg edwrvflken alsfrsalls
YP_001370475   whfknkrvll dalaetilae hhdhalprag enwrhflien ahsfrrallt
P21337         whvrnkqtlm nmlseailak hhtrsaplpt eswqqflqen alsfrkallv
AAA98409       whlrnkqtlm nmlseailak hhtrsaplpt eswqqflqen alsfrkallv
CAC81917       whvrnkqtlm nmlseailak hhtrsvplpt eswqqflqen alsfrkallv
P51561         whvknkrall dalaetilqk hhhhvlplpn etwqdflrnn aksfrqallm
ZP_00132379    whvknkrall dalaetilqk hhhhvlplpn etwqdflrnn aksfrqallm
AAD12754       whvknkrall dalaetilqk hhhhvlplan eswqdflrnn aksfrqallm
P04483         whvknkrall dalaiemldr hhthfcpleg eswqdflrnn aksfrcalls
A26948         whvknkrall dalaiemldr hhthfcpleg eswqdflrnn aksfrcalls
CAC80726       whvknkrall dalsveillr hhdhfqpqkg eywadflren aksfrralls
P0ACT4         WHVKNKRALL DALAVEILAR HHDYSLPAAG ESWQSFLRNN AMSFRRALLR
ZP_01567051    whyrdksvll aemaavalar hhtldvpadt aqwdawfadn arsfrralla
NP_824556      whfknkqall dematemyrr mtegahlapg aswqerllhg nralrtallg
                      101                                                 150
ZP_01558383    yrdgarlhag tr.prtlhfg sierkvalla eagfapdeav dvmyalgrfv
YP_772551      yrdgarlhag tr.prtlhfd sierkvallg dagfapdeav dvmyalgrfv
YP_620166      yrdgarlhag tr.pralhfs sierkvallg eagfkpdeav dvmyaigrfv
EAY62734       yrdgarlhag tr.pralhfs sierkvallg eagfkpdeav dvmyaigrfv
YP_368094      yrdgarlhag tr.pralhfs sierkvallg dagfapdeav dvmyalgrfv
AAP93923       yrdgarlhag tr.pqepqfa iieakvallc ragftpehav nllfavgrfi
AAW66496       yrdgarlhar ts.psqghfn tieaqvalls hagfspveav allmtlgrfi
CAA24908       yrdgarihag tr.pgapqme tadaqlrflc eagfsagdav nalmtisyft
P03038         yrdgarihag tr.pgapqme tadaqlrflc eagfsagdav nalmtisyft
ABS19067       yrdgarihag tr.pgapqme vvdaqlrflc eagfsawdav nalmtisyft
NP_387462      yrdgarihag tr.saapqme kadaqlrflc dagfsagdat yalmaisyft
```

```
NP_387455      yrdgarihag  tr.paapqme  kadaqlrflc  dagflagdat  yalmaisyft
AAR96033       yrdgarihag  tr.paapqme  kadaqlrflc  dagfsagdat  yalmaisyft
NP_511232      yrdgarihag  tr.paapqme  kadaqlrflc  dagfsagdat  yalmaisyft
AAW83818       yrdgarihag  tr.paapqme  kadaqlrflc  dagfsagdat  yalmaisyft
AAD25094       yrdgarihag  tr.ptepnfg  taetqirflc  aegfcpkrav  walravshyv
ABO14708       yrdgarihag  tr.ptepnfg  taetqirflc  aegfcpkrav  walravshyv
P51560         yrdgarihag  tr.ptepnfg  taetqirflc  aegfcpkrav  walravshyv
AAD25537       yrdgarihag  tr.ptephyg  taeaqirflc  tagfspkrav  walwavshyv
YP_001220607   yrdgarihag  tr.ptsaqye  rvekqirflc  esgfeqpdav  ralvivshyt
YP_001370475   yrdgahihag  tr.pnnnqag  qaetqiefli  qagfpanaa  raliaishyv
P21337         hrdgarlhig  ts.ptppqfe  qaeaqlrclc  dagfsveeal  filqsishft
AAA98409       hrdgarlhig  ts.ptppqfe  qaeaqlrclc  dagfsveeal  filqsishft
CAC81917       hrdgarlhig  ts.ptppqfe  qaeaqlrclc  dagfsveeal  filqsishft
P51561         yrdggkihag  tr.psesqfe  tseqqlqflc  dagfslsqav  yalssiahft
ZP_00132379    yrdggkihag  tr.psesqfe  tseqqlqflc  dagfslsqav  yalssiahft
AAD12754       yrdggkihag  tr.psanqfe  tseqqlqflc  dagftltqav  yalssiahft
P04483         hrdgakvhlg  tr.ptekqye  tlenqlaflc  qqgfslenal  yalsavghft
A26948         hrdgakvhlg  tr.ptekqye  tlenqlafya  nkvfh~~~~~ ~~~~~~~~~~
CAC80726       hrdaakihlg  tr.pspeqfe  tveaqlaflc  eqgfsleeal  ytlgvvshft
P0ACT4         YRDGAKVHLG  TR.PDEKQYD  TVETQLRFMT  ENGFSLRDGL  YAISAVSHFT
ZP_01567051    hrdgarlhlg  st.pdldave  rirpkiaylv  raglteqeag  mamlaagqft
NP_824556      yrdgakvfsg  srftgtehav  qleaslrslv  eagfdlpqav  ratstayfft
               151                                                    200
ZP_01558383    vgwvleeqae  aeretd....  .ttlpdtaeh  p..llaqgwa  alrerggdea
YP_772551      vgwvleeqae  aeretd....  .ttlpdtaeh  p..llaqgwt  alrerggdea
YP_620166      vgwvleeqar  pdgdtd....  .allpdaaey  p..lfaqgwa  alrersgdea
EAY62734       vgwvleeqar  pdgdad....  .allpdaaey  p..lfakgwa  alrersgdea
YP_368094      vgwvleeqae  ssdeaa....  .aplpdaaey  p..llakgwa  alrgrsgdda
AAP93923       vgwvleeqqm  qpdda.....  .lneadrrry  p..llcggwe  klqdkgadal
AAW66496       vgwvleeqqe  eirsdp....  .pfeadptiy  p..lmlqggvn tlqnmnaddi
CAA24908       vgavleeqag  dsesgergg.  ..tveqapls  p..llraaid  afdeagpdaa
P03038         vgavleeqag  dsdagergg.  ..tveqapls  p..llraaid  afdeagpdaa
ABS19067       vgavleeqag  dsdagergg.  ..tieqa...  p..llravid  tfdeagpdav
NP_387462      vgavleqqas  eadaeerged  qlttsastmp  a..rlqsamk  ivyeggpdaa
NP_387455      vgavleqqas  eadaeerged  qlttsastmp  a..rlqsamk  ivyeggpdaa
AAR96033       vgavleqqas  eadaeerged  qlttsastmp  a..rlqsamk  ivyeggpdaa
NP_511232      vgavleqqas  eadaeerged  qlttsastmp  a..rlqsamk  ivyeggpdaa
AAW83818       vgavleqqas  eadaeerged  qlttsastmp  a..rlqsamk  ivyeggpdaa
AAD25094       vgsvleqqas  ..dadervpd  rpdvseqaps  s..flhdlfh  eletdgmdaa
ABO14708       vgsvleqqas  ..dadervpd  rpdvseqaps  s..flhdlfh  eletdgmdaa
P51560         vgsvleqqas  ..dadervpd  rpdvseqaps  s..flhvlfh  eletdgmdaa
AAD25537       vgsvleqqas  ..nandrmsd  ksdvseqaps  s..flhdlfh  eletdgmdap
YP_001220607   tgsvseqqaa  ledssserkqa skeapaq.ps  q..flshafd  tfdaegadfa
YP_001370475   vgsaleqqa.  ..dihesvpg  ..davsitat  s..eiaqaia  ildadgaenl
P21337         lgavleeq..  atnqien..n  hvid...aap  p..llqeafn  iqartsaema
AAA98409       lgavleeq..  atnqien..n  hvid...aap  p..llqeafn  iqartsaema
CAC81917       lgavleeq..  atnptey..n  tvmd...avp  p..llqeafn  vqtrttaeta
P51561         lgsvletqeh  qesqker..e  kvetdtvayp  p..lltqava  imdsdngdaa
ZP_00132379    lgsvletqeh  qesqker..e  kvetdtvayp  p..lltqava  imdsdngdaa
AAD12754       lgsvletqeh  qesqker..e  kvpkteinyp  p..lltqaid  imdsdngeaa
P04483         lgcvledqeh  qvakeer..e  tpttdsm..p  p..llrqaie  lfdhqgaepa
A26948         ~~~~~~~~~~ ~~~~~~~~~~ ~~~~~~~~~~ ~~~~~~~~~~ ~~~~~~~~~~
CAC80726       lgsvleerey  leamrdd..d  paihaam..p  p..lltkale  imeqdtgekp
P0ACT4         LGAVLEQQEH  TAALTDR..P  AAPDENL..P  P..LLREALQ  IMDSDDGEQA
ZP_01567051    igcvleqqaa  qgrgaeepar  rdaaddrp..  ......rtsga alapidpgva
NP_824556      lgfvteeqgv  eplpgerreg  ydvderaarm  adfplaaaag  aeifqnyeeg
               201                             237
ZP_01558383    fergvalivd  gararla.ar  rrgg~~~~~~ ~~~~~~~
YP_772551      fergvalivd  gararla.ar  qrgg~~~~~~ ~~~~~~~
YP_620166      fergiawivd  gararla.ar  rag~~~~~~~ ~~~~~~~
EAY62734       fergiawivd  gararla.ar  rag~~~~~~~ ~~~~~~~
YP_368094      fergvawivd  gararla.ar  erg~~~~~~~ ~~~~~~~
AAP93923       feaglrllvd  gaeaaltnan  nhgaqs~~~~ ~~~~~~~
AAW66496       fengirmvii  gaerqldikm  qt~~~~~~~~ ~~~~~~~
CAA24908       feqglavivd  glakrrlvvr  nvegprkgdd ~~~~~~~
P03038         feqglavivd  glakrrlvvr  nvegprkgdd ~~~~~~~
ABS19067       felglavivd  glakrrlvar  niqgprkgdd ~~~~~~~
NP_387462      ferglaliig  gleqvrlspa  sspagrtnlv lalaags
NP_387455      ferglaliig  gleqvrlspa  sspagrtnlv lalaags
AAR96033       ferglaliig  glersacais  ll~~~~~~~~ ~~~~~~~
NP_511232      ferglaliig  glekmrlttn  dievlknvde ~~~~~~~
AAW83818       ferglaliig  glersacais  ll~~~~~~~~ ~~~~~~~
AAD25094       fnfgldslia  gferlrss..  ttd~~~~~~~ ~~~~~~~
ABO14708       fnfgldslia  gferlrss..  ttd~~~~~~~ ~~~~~~~
P51560         fnfgldslia  gferlraavl  atd~~~~~~~ ~~~~~~~
AAD25537       fnfgldslia  gfeqlrls..  ttd~~~~~~~ ~~~~~~~
YP_001220607   feygldalis  glemkkatk~ ~~~~~~~~~~ ~~~~~~~
YP_001370475   fdfglmllvd  glerhrqs~~ ~~~~~~~~~~ ~~~~~~~
P21337         fhfglkslif  gfsaqldekk  htpiedgnk~ ~~~~~~~
AAA98409       fhfglkslif  gfsaqldekk  htpiedgnk~ ~~~~~~~
```

-continued

```
CAC81917      fhfglrsliv  gfsaqlde.k  ymsiqgnnk~  ~~~~~~
P51561        flfvldvmis  gletvlksak  ~~~~~~~~~~  ~~~~~~~
ZP_00132379   flfvldvmis  gletvlksak  ~~~~~~~~~~  ~~~~~~~
AAD12754      flfvldvmis  gletvlnnhh  ~~~~~~~~~~  ~~~~~~~
P04483        flfgleliic  glekqlkces  gs~~~~~~~~  ~~~~~~~
A26948        ~~~~~~~~~~  ~~~~~~~~~~  ~~~~~~~~~~  ~~~~~~~
CAC80726      flfgleviil  gleakqkqkk  gnqe~~~~~~  ~~~~~~~
P0ACT4        FLHGLESLIR  GFEVQLTALL  QIVGGDKLII  PFC~~~~
ZP_01567051   fefglglivd  glrrrvdra~  ~~~~~~~~~~  ~~~~~~~
NP_824556     feeglrlvia  giearygir~  ~~~~~~~~~~  ~~~~~~~
```

Amino acid positions having relatively conserved amino acid substitutions between family members were considered for harvesting diversity. In addition, positions were chosen for variation based on spacing to limit the number of changes in a pair of overlapping oligonucleotides. A summary of the library is shown in Table 11. The objective of this library was to recover hits improved for reactivity to either ethametsulfuron or chlorsulfuron.

TABLE 11

| | | | | | | | | | | | | | | Residue Position | | | | | | |
|---|---|---|---|---|---|---|---|---|---|---|---|---|---|---|---|---|---|---|---|---|
| L1-9 Backbone Sequence | 52 L | 55 L | 62 R | 69 P | 73 E | 76 Q | 79 L | 83 A | 85 S | 88 C | 93 H | 96 G | 98 K | 101 L | 102 G | 109 Q | 110 Y | 114 E | 117 L | 120 L |
| Shuffling Diversity | L M | L M | D E K R | L P | A D E | F D Q V | A L S R | A N G S | C G R N S | H Y | A G R | K R | I L | G R | H N Q Y | F V R V | D E L | I M V Y |  |  |

| | | | | | | | | | | | Residue Position | | | | |
|---|---|---|---|---|---|---|---|---|---|---|---|---|---|---|---|
| L1-9 Backbone Sequence | 125 F | 129 N | 130 A | 137 V | 140 F | 145 V | 149 Q | 162 T | 167 P | 170 L | 175 E | 181 G | 183 E | 189 G | 190 L | 193 I | 197 L |
| Shuffling Diversity | F L | D E H N Q | A G | A I L V | F Y | A V | Q R | Q T | P S | F I L M | D E S N | G G | D E V | G I | I L M V | I L V L | A F I L |

Assembly of the L4 library synthetic oligonucleotides was done as for the previous libraries, except that two sets of oligonucleotide pools were used. First, multiple oligonucleotides representing diversity at a single oligonucleotide annealing location are pooled ("Group" in Table 12). Next, an equal volume of each group of oligos is pooled to represent the novel L4 diversity. Likewise, oligonucleotides representing the L1-9 backbone sequence were pooled (Table 13). The L4 assembly reaction was carried out by spiking the oligonucleotide diversity pool into the L1-9 backbone pool at an approximately 1:3 ratio.

TABLE 12

| Oligo | Sequence | Group | SEQ ID |
|---|---|---|---|
| L4:01 | TATTGGCATGTAAAAAATAAGCGAGCTCTGWTGGACGCCWTG | 1 | 987 |
| L4:02 | TATTGGCATGTAAAGAATAAGVGCGCTCTGWTGGACGCCWTG | 1 | 988 |
| L4:03 | GCCATTGAGATGCTCGATARACACGCCACTCACTTTTGCCYC | 2 | 989 |
| L4:04 | GCCATTGAGATGCTCGATGAKCACGCCACTCACTTTTGCCYC | 2 | 990 |
| L4:05 | TTAGAAGGGGMWAGCTGGCAAGATTTTBTTCGTAATAACGCA | 3 | 991 |
| L4:06 | TTAGAAGGGGMWAGCTGGCAAGATTTTBTTCGTAATAACART | 3 | 992 |
| L4:07 | TTAGAAGGGGMWAGCTGGAGGGATTTTBTTCGTAATAACGCA | 3 | 993 |
| L4:08 | TTAGAAGGGGMWAGCTGGAGGGATTTTBTTCGTAATAACART | 3 | 994 |
| L4:09 | TTAGAAGGGGMWAGCTGGGMTGATTTTBTTCGTAATAACGCA | 3 | 995 |

TABLE 12-continued

| Oligo | Sequence | Group | SEQ ID |
|---|---|---|---|
| L4:10 | TTAGAAGGGGMWAGCTGGGMTGATTTTBTTCGTAATAACART | 3 | 996 |
| L4:11 | AAAARTATGAGAHGTGCTTTACTAAGTYACCGCGATGSAGCA | 4 | 997 |
| L4:12 | AAAGSAATGAGAHGTGCTTTACTAAGTYACCGCGATGSAGCA | 4 | 998 |
| L4:13 | ARAGTATGCTCCRGGACAGGATTTACAGAAAAACAAKTTGAA | 5 | 999 |
| L4:14 | ARAGTATGCTCCRGGACAGGATTTACAGAAAAACAATACGAA | 5 | 1000 |
| L4:15 | ARAGTATGCTCCRGGACAGGATTTACAGAAAAAMATKTTGAA | 5 | 1001 |
| L4:16 | ARAGTATGCTCCRGGACAGGATTTACAGAAAAAMATTACGAA | 5 | 1002 |
| L4:17 | ARAGTATGCMTCRGGACAGGATTTACAGAAAAACAAKTTGAA | 5 | 1003 |
| L4:18 | ARAGTATGCMTCRGGACAGGATTTACAGAAAAACAATACGAA | 5 | 1004 |
| L4:19 | ARAGTATGCMTCRGGACAGGATTTACAGAAAAAMATKTTGAA | 5 | 1005 |
| L4:20 | ARAGTATGCMTCRGGACAGGATTTACAGAAAAAMATTACGAA | 5 | 1006 |
| L4:21 | ACTGCTGAMAATTCAVTTGCCTTTMTGTGCCAACAAGGTTTK | 6 | 1007 |
| L4:22 | ACTGCTGAMAATTCAVTTGCCTTTTACTGCCAACAAGGTTTK | 6 | 1008 |
| L4:23 | ACTGCTAGGAATTCAVTTGCCTTTMTGTGCCAACAAGGTTTK | 6 | 1009 |
| L4:24 | ACTGCTAGGAATTCAVTTGCCTTTTACTGCCAACAAGGTTTK | 6 | 1010 |
| L4:25 | TCACTAGAGVACGSATTATATGCAATGCAAGCTGCATGTATT | 7 | 1011 |
| L4:26 | TCACTAGAGVACGSATTATATGCAATGCAAGCTVTCTGTATT | 7 | 1012 |
| L4:27 | TCACTAGAGSAAGSATTATATGCAATGCAAGCTGCATGTATT | 7 | 1013 |
| L4:28 | TCACTAGAGSAAGSATTATATGCAATGCAAGCTVTCTGTATT | 7 | 1014 |
| L4:29 | TWCACTTTAGGTTGCGYATTGCTCGATCAAGAGTTGCAAGTC | 8 | 1015 |
| L4:30 | TWCACTTTAGGTTGCGYATTGCTCGATCGTGAGTTGCAAGTC | 8 | 1016 |
| L4:31 | GCTAAAGAAGAAAGGGAAACACCTCAAACTGATAGTATGYCT | 9 | 1017 |
| L4:32 | GCTAAAGAAGAAAGGGAAACACCTACTACTGATAGTATGYCT | 9 | 1018 |
| L4:33 | CCATTAWTKCGACAAGCTTTGAATTTAAAGGATCACCAARGC | 10 | 1019 |
| L4:34 | CCATTAWTKCGACAAGCTTTGGAWTTAAAGGATCACCAARGC | 10 | 1020 |
| L4:35 | GCAGRWCCAGCCTTCTTATTCGKGVTTGAATTGVTKATATGC | 11 | 1021 |
| L4:36 | GGAHTTGAAAAACAACTTAAATGTGAAAGTGGGTCTTAA | 12 | 1022 |
| L4:37 | GGAGCTGAAAAACAACTTAAATGTGAAAGTGGGTCTTAA | 12 | 1023 |
| L4:38 | TYTATCGAGCATCTCAATGGCCAWGGCGTCCAWCAGAGCTCG | 13 | 1024 |
| L4:39 | MTCATCGAGCATCTCAATGGCCAWGGCGTCCAWCAGAGCTCG | 13 | 1025 |
| L4:40 | TYTATCGAGCATCTCAATGGCCAWGGCGTCCAWCAGAGCGCB | 13 | 1026 |
| L4:41 | MTCATCGAGCATCTCAATGGCCAWGGCGTCCAWCAGAGCGCB | 13 | 1027 |
| L4:42 | TTGCCAGCTWKCCCCTTCTAAGRGGCAAAAGTGAGTGGCGTG | 14 | 1028 |
| L4:43 | CCTCCAGCTWKCCCCTTCTAAGRGGCAAAAGTGAGTGGCGTG | 14 | 1029 |
| L4:44 | AKCCCAGCTWKCCCCTTCTAAGRGGCAAAAGTGAGTGGCGTG | 14 | 1030 |
| L4:45 | TAAAGCACDTCTCATAYTTTTGCGTTATTACGAAVAAAATC | 15 | 1031 |
| L4:46 | TAAAGCACDTCTCATTSCTTTTGCGTTATTACGAAVAAAATC | 15 | 1032 |
| L4:47 | TAAAGCACDTCTCATAYTTTTAYTGTTATTACGAAVAAAATC | 15 | 1033 |

TABLE 12-continued

| Oligo | Sequence | Group | SEQ ID |
|---|---|---|---|
| L4:48 | TAAAGCACDTCTCATTSCTTTAYTGTTATTACGAAVAAAATC | 15 | 1034 |
| L4:49 | TCCTGTCCYGGAGCATACTYTTGCTSCATCGCGGTRACTTAG | 16 | 1035 |
| L4:50 | TCCTGTCCYGAKGCATACTYTTGCTSCATCGCGGTRACTTAG | 16 | 1036 |
| L4:51 | GGCAABTGAATTKTCAGCAGTTTCAAMTTGTTTTTCTGTAAA | 17 | 1037 |
| L4:52 | GGCAABTGAATTCCTAGCAGTTTCAAMTTGTTTTTCTGTAAA | 17 | 1038 |
| L4:53 | GGCAABTGAATTKTCAGCAGTTTCGTATTGTTTTTCTGTAAA | 17 | 1039 |
| L4:54 | GGCAABTGAATTCCTAGCAGTTTCGTATTGTTTTTCTGTAAA | 17 | 1040 |
| L4:55 | GGCAABTGAATTKTCAGCAGTTTCAAMATKTTTTTCTGTAAA | 17 | 1041 |
| L4:56 | GGCAABTGAATTCCTAGCAGTTTCAAMATKTTTTTCTGTAAA | 17 | 1042 |
| L4:57 | GGCAABTGAATTKTCAGCAGTTTCGTAATKTTTTTCTGTAAA | 17 | 1043 |
| L4:58 | GGCAABTGAATTCCTAGCAGTTTCGTAATKTTTTTCTGTAAA | 17 | 1044 |
| L4:59 | ATATAATSCGTBCTCTAGTGAMAAACCTTGTTGGCACAKAAA | 18 | 1045 |
| L4:60 | ATATAATSCTTSCTCTAGTGAMAAACCTTGTTGGCACAKAAA | 18 | 1046 |
| L4:61 | ATATAATSCGTBCTCTAGTGAMAAACCTTGTTGGCAGTAAAA | 18 | 1047 |
| L4:62 | ATATAATSCTTSCTCTAGTGAMAAACCTTGTTGGCAGTAAAA | 18 | 1048 |
| L4:63 | CAATRCGCAACCTAAAGTGWAAATACATGCAGCTTGCATTGC | 19 | 1049 |
| L4:64 | CAATRCGCAACCTAAAGTGWAAATACAGABAGCTTGCATTGC | 19 | 1050 |
| L4:65 | TGTTTCCCTTTCTTCTTTAGCGACTTGCAACTCTTGATCGAG | 20 | 1051 |
| L4:66 | TGTTTCCCTTTCTTCTTTAGCGACTTGCAACTCACGATCGAG | 20 | 1052 |
| L4:67 | CAAAGCTTGTCGMAWTAATGGAGRCATACTATCAGTTTGAGG | 21 | 1053 |
| L4:68 | CAAAGCTTGTCGMAWTAATGGAGRCATACTATCAGTAGTAGG | 21 | 1054 |
| L4:69 | GAATAAGAAGGCTGGWYCTGCGCYTTGGTGATCCTTTAAATT | 22 | 1055 |
| L4:70 | GAATAAGAAGGCTGGWYCTGCGCYTTGGTGATCCTTTAAWTC | 22 | 1056 |
| L4:71 | TTTAAGTTGTTTTTCAADTCCGCATATMABCAATTCAABCMC | 23 | 1057 |
| L4:72 | TTTAAGTTGTTTTTCAGCTCCGCATATMABCAATTCAABCMC | 23 | 1058 |
| L1:50 | GGGAACTTCGGCGCGCCTTAAGACCCACTTTCACA | 24 | 1059 |

TABLE 13

| Oligo | Sequence | SEQ ID |
|---|---|---|
| L1-9:01 | TATTGGCATGTAAAGAATAAGCGTGCTCTGTTGGACGCCCTG | 1060 |
| L1-9:02 | GCCATTGAGATGCTCGATCGTCACGCCACTCACTTTTGCCCT | 1061 |
| L1-9:03 | TTAGAAGGGGAAAGCTGGCAAGATTTTCTCCGTAATAATGCA | 1062 |
| L1-9:04 | AAATCAATGAGATGCGCTTTACTAAGTCATCGCGATGGGGCA | 1063 |
| L1-9:05 | AAGGTATGTCTTGGTACAGGATTCACAGAAAAACAGTACGAA | 1064 |
| L1-9:06 | ACTGCTGAAAATAGTTTGGCCTTTCTGTGCCAACAAGGTTTC | 1065 |
| L1-9:07 | TCACTAGAGAATGCTTTATATGCAATGCAAGCTGTCTGTATC | 1066 |
| L1-9:08 | TTCACTTTAGGTTGCGTTTTGCTGGATCAAGAGCTCCAAGTC | 1067 |
| L1-9:09 | GCTAAAGAAGAAAGGGAAACACCTACTACTGATAGTATGCCC | 1068 |
| L1-9:10 | CCATTATTGCGACAAGCTTTGGAATTAAAAGATCACCAAGGG | 1069 |
| L1-9:11 | GCAGAGCCAGCCTTCTTATTCGGATTGGAATTGATAATATGC | 1070 |
| L1-9:12 | GGATTGGAAAAACAACTTAAATGTGAAAGTGGGTCTTAA | 1071 |

TABLE 13-continued

| Oligo | Sequence | SEQ ID |
|---|---|---|
| L1-9:13 | ACGATCGAGCATCTCAATGGCCAGGGCGTCCAACAGAGCACG | 1072 |
| L1-9:14 | TTGCCAGCTTTCCCCTTCTAAAGGGCAAAAGTGAGTGGCGTG | 1073 |
| L1-9:15 | TAAAGCGCATCTCATTGATTTTGCATTATTACGGAGAAAATC | 1074 |
| L1-9:16 | TCCTGTACCAAGACATACCTTTGCCCCATCGCGATGACTTAG | 1075 |
| L1-9:17 | GGCCAAACTATTTTCAGCAGTTTCGTACTGTTTTTCTGTGAA | 1076 |
| L1-9:18 | ATATAAAGCATTCTCTAGTGAGAAACCTTGTTGGCACAGAAA | 1077 |
| L1-9:19 | CAAACGCAACCTAAAGTGAAGATACAGACAGCTTGCATTGC | 1078 |
| L1-9:20 | TGTTTCCCTTTCTTCTTTAGCGACTTGGAGCTCTTGATCCAG | 1079 |
| L1-9:21 | CAAAGCTTGTCGCAATAATGGGGCATACTATCAGTAGTAGG | 1080 |
| L1-9:22 | GAATAAGAAGGCTGGCTCTGCCCCTTGGTGATCTTTTAATTC | 1081 |
| L1-9:23 | TTTAAGTTGTTTTTCCAATCCGCATATTATCAATTCCAATCC | 1082 |
| L1-9:24 | GGGAACTTCGGCGCGCCTTAAGACCCACTTTCACA | 1083 |

The assembly reaction products were cloned into the pVER7314 backbone and transformed into tester strain *E. coli* KM3. To carry out library diversity analysis, DNA preps from 96 colonies grown on LB+Cb only (representing no repressor positive selection bias) were subjected to sequence analysis. These data showed approximately 30% of the clones recovered were unaltered L1-9 backbone and the remaining clones had approximately one to two targeted changes per clone. Additional non-targeted residue changes were recovered in the mutated population, either due to PCR errors or from poor quality oligonucleotides incorporated into the assembly reactions.

I. Library L4 Screening

Figure 4:
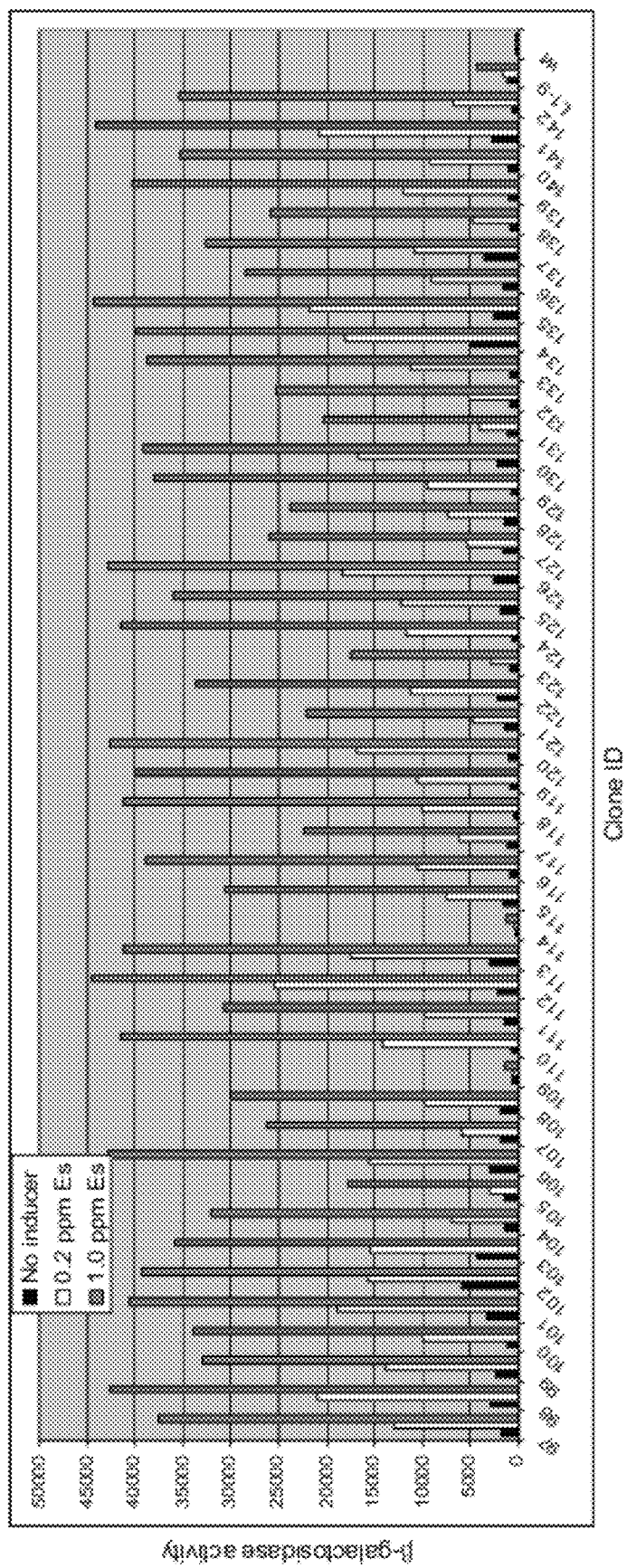
FIG. 4. Relative β-galactosidase activities of 45 putative library L4 hits against 0, 0.2 and 1.0 ppm ethametsulfuron (Es). Induced activity was measured using 5 μl of perforated whole cell mixture, and background activity was measured using 25 μl perforated cell mixture so that detectable activity could be measured in the same time frame for all treatments. Background activity values were multiplied by 10 in order to bring them into the display range of the graph. The right hand side of the graph contains the controls, wild type TetR and 1$^{st}$ round hit L1-9.

Approximately 20,000 clones arising from the repressor prescreen were tested for activation by 0, 0.2 and 1 µg/ml concentrations of ethametsulfuron using the M9 assay plates. Surprisingly, over 100 hits were observed from the 0.2 µg/ml ethametsulfuron treatment. These putative hits were re-arrayed in 96-well format and re-tested for β-galactosidase induction by 0, 0.2 and 1 ppm ethametsulfuron using a liquid culture based assay system. FIG. 4 shows relative β-galactosidase activities of 45 exemplary putative library L4 hit clones 97-142 against 0, 0.2 and 1 ppm ethametsulfuron. Cultures grown in 96-well format were subcultured into fresh LB with inducer at the indicated concentration and grown overnight and then processed for the enzyme assay. For detection of induced activity, 5 µl of perforated cell mixture was used. For detection of background activity, 25 µl of cells were used such that detectable activity could be measured in the same time frame for all treatments. Background activity values were multiplied by ten to bring them into the range of the graph. The numbers below each sample refers to the library clone number. The latter part of the graph contains the controls 1st round hit L1-9 as well as wt TetR.

DNA sequences for all 142 putative hit clones were determined and the translated polypeptides aligned. After assigning each polypeptide in the alignment with a relative ethametsulfuron response, patterns of amino acid incorporation at varied or mutated residues associated with high or low response activity and high or low uninduced activity were identified. The most significant findings from this analysis were: C138G or L170V mutations were heavily favored in the top clones L4-59, -89, -110, -116, -118, -120, -124, -129, -133, -139, -140 and -142; and K108 Q was heavily incorporated in clones with the highest activity at the lowest dose of 0.2 ppm, but these clones showed somewhat leaky background (e.g., L4-98, -106, -113, -126, -130, and -141). Results from clone L4-18 having the K108Q shows another possible interesting mutation of L55M. This clone is induced to a high level with 0.2 ppm Es, but does not show the associated high background activity typically observed for K108Q-containing clones. The L55M mutation may have increased repressor activity. It is of interest that none of these changes other than L55M were designed diversity—all were derived from false incorporation of nucleotides during library assembly and few of these changes were represented in the unselected clone population.

J. Third Round Library Designs and Screening

Library L6: Shuffling for Enhanced Chlorsulfuron Response

Since clones L2-14 and L2-18 had the best chlorsulfuron activity profile from library L2, their amino acid diversity was used as the basis for the next round of shuffling. In addition to the diversity provided by these backbone sequences, additional residue changes thought to enhance packing of chlorsulfuron based on the 3D model predictions were included. New amino acid positions targeted were 67, 109, 112 and 173 (see, Table 14). Substitution of Gln (Q) at position 108 and Val (V) at position 170 were shown to likely be important changes in library L4 for gaining enhanced SU responsiveness and so were varied here as well. A summary of the diversity chose is shown in Table 14. The oligonucleotides designed and used to generate library 6 are shown in Table 15.

Library L6 was assembled, rescued, ligated into pVER7314, transformed into *E. coli* KM3 and plated out onto LB carbenicillin/kanamycin, and carbenicillin only control media as before. Library plates were then picked into 42 384-well microtiter plates (~16,000 clones) containing 60 µl LB carbenicillin (Cb) broth per well. After overnight growth at 37° C. the cultures were stamped onto M9 assay plates containing no inducer, 0.2 ppm, and 2.0 ppm chlorsulfuron as test inducer. Following incubation at 30° C. for ~48 hrs, putative hits responding to chlorsulfuron treatment as determined by increased blue colony color were re-arrayed into six 96-well microtiter plates and used to stamp a fresh set of M9 assay plates to confirm the above results. For a more detailed analysis of the relative induction by chlorsulfuron, digital photographs were taken of the plates after various time points of incubation at 30° C. and colony color intensity measured using the digital image analysis freeware program ImageJ (Rasband, US National Institutes of Health, Bethesda, Md., USA, rsb.info.nih.gov/ij/, 1997-2007). Using these results enabled ranking of clones in multiplex format by background activity (no inducer), activation with low or high level inducer application (blue color with inducer), and fold activation (activation divided by background). Activation studies using 0.2 µg/ml chlorsulfuron as inducer for the top set of clones shows an approximately 3 fold improvement in activation while obtaining lower uninduced levels of expression (Table 12). In addition to this analysis, DNA sequence information for most clones (490 clones) was obtained and the deduced polypeptides aligned with each other as well as with their corresponding activity information. From this analysis sequence-activity relationships were derived (Table 12). Residues biased for improved activity are indicated in larger bold type. Briefly, C at position 100, and Q at positions 108 and 109 strongly correlated with activation, while R at position 138, L at position 170, and A or G at position 173 were highly preferred in clones with the lowest background activity. Though some positions were strongly biased, i.e., observed more frequently in the selected population, the entirety of introduced diversity was observed in the full hit population. This information will aid in the design of further libraries to improve responsiveness to chlorsulfuron.

TABLE 15

| Oligo | Sequence | SEQ ID |
|---|---|---|
| L6:1 | TATTGGCATGTAAAAAATAAGCGAGCTCTGCTCGACG CCTTA | 1084 |
| L6:2 | GCAGAGCCAGCCTTCTTATTCGGCCTTGAATTGATCA TATGC | 1085 |
| L6:3 | ATATAATGCATTCTCTAGTGAAAAACCTTGTTGGCAT AAAAA | 1086 |
| L6:4 | TTTAAGTTGTTTTTCTAATCCGCATATGATCAATTCA AGGCC | 1087 |
| L6:5 | TTAGAAGGGGAAAGCTGGCAAGATTTTTTACGTAATA MTGCT | 1088 |

TABLE 14

| Sequence Name | Amino acid residue position ||||||||||||||
|---|---|---|---|---|---|---|---|---|---|---|---|---|---|---|
| | 60 | 64 | 67 | 82 | 86 | 100 | 105 | 108 | 109 | 112 | 113 | 116 | 134 | 138 | 139 | 147 |
| Library Diversity | | A Q | M Y F L I V | N T | | C W | | Q K | M L Q H | S T A G | | | M Q | M V | G R | N V |
| wt reference | L | H | F | N | F | H | P | K | Q | T | L | Q | L | G | H | E |
| L2-14 | M | A | F | N | M | C | W | K | Q | T | A | M | V | R | V | F |
| L2-18 | M | Q | F | T | M | W | W | K | Q | T | A | Q | M | R | N | F |
| L6-1B03 | M | A | I | N | M | C | W | Q | Q | A | A | M | V | R | V | F |
| L6-2C09 | M | Q | Y | T | M | C | W | Q | L | T | A | Q | M | R | V | F |
| L6-2D07 | M | Q | F | T | M | C | W | Q | Q | T | A | M | M | R | V | F |
| L6-3H02 | M | A | Y | T | M | C | W | Q | H | S | A | M | V | R | V | F |
| L6-4D10 | M | Q | Y | N | M | C | W | K | Q | S | A | M | V | R | V | F |
| L6-5F05 | M | A | I | N | M | C | W | Q | Q | A | A | Q | V | R | V | F |
| L6-5G06 | M | Q | Y | N | M | C | W | Q | Q | T | A | Q | V | R | V | F |
| L6-5H06 | M | Q | I | N | M | C | W | K | Q | T | A | M | V | R | V | F |
| L6-5H12 | M | A | Y | N | M | C | W | K | Q | T | A | Q | M | R | V | F |
| L6-6F07 | M | A | L | T | M | C | W | Q | Q | S | A | M | M | R | V | F |
| Bias in top population | | none | Y | N | | C | | Q | Q | none | | none | V | R | V | |

| Sequence Name | Amino acid residue positiion |||||||  |  |  |
|---|---|---|---|---|---|---|---|---|---|---|
| | 151 | 164 | 170 | 173 | 174 | 177 | 178 | 0.2 ppm 48 hr | Control 84 hr | 0.2 ppm 48 hr/ Control 84 hr |
| Library Diversity | S L | | L A V | G A V | L W | | | | | |
| wt reference | H | D | L | A | I | F | D | 5.2 | 5.3 | 1.0 |
| L2-14 | S | A | L | A | L | K | D | 11.8 | 6.6 | 1.8 |
| L2-18 | L | A | L | A | W | K | D | 5.9 | 5.7 | 1.0 |
| L6-1B03 | S | A | L | A | W | K | D | 30.0 | 6.6 | 4.6 |
| L6-2C09 | L | A | L | A | W | K | D | 13.6 | 5.2 | 2.6 |
| L6-2D07 | S | A | V | A | W | K | D | 20.0 | 5.8 | 3.4 |
| L6-3H02 | S | A | V | A | W | K | V | 15.8 | 5.6 | 2.8 |
| L6-4D10 | S | A | L | A | W | K | D | 18.4 | 5.0 | 3.7 |
| L6-5F05 | L | A | L | A | W | K | D | 22.0 | 5.4 | 4.1 |
| L6-5G06 | L | A | L | G | W | K | D | 34.4 | 7.0 | 4.9 |
| L6-5H06 | L | A | V | A | W | K | D | 13.7 | 5.1 | 2.7 |
| L6-5H12 | L | A | V | A | W | K | D | 23.7 | 5.7 | 4.2 |
| L6-6F07 | S | A | L | A | W | K | D | 11.6 | 5.1 | 2.3 |
| Bias in top population | none | | L | A/G | W | | D | | | |

TABLE 15-continued

| Oligo | Sequence | SEQ ID |
|---|---|---|
| L6:6 | TAAAGCACATCTCATACTTTTAGCAKTATTACGTAAAAAATC | 1089 |
| L6:7 | TTGCCAGCTTTCCCCTTCTAAAGGGCAMAHGTGAGTTGCGTG | 1090 |
| L6:8 | TTGCCAGCTTTCCCCTTCTAAAGGGCAATAGTGAGTTGCGTG | 1091 |
| L6:9 | GAATAAGAAGGCTGGCTCTGCACCTTGGTGATCCTTTAATTC | 1092 |
| L6:10 | GCCATTGAGATGATGGATAGGCACGCAACTCACTATTGCCCT | 1093 |
| L6:11 | RSTGCTGAAAATATGTTAGCCTTTTTATGCCAACAAGGTTTT | 1094 |
| L6:12 | TTTACTTTAGGTTGCGTATTGTTTGATCAAGAGCTCCAAGTC | 1095 |
| L6:13 | TGTTTCCCTTTCTTCTTTAGCGACTTGGAGCTCTTGATCAAA | 1096 |
| L6:14 | GCCATTGAGATGATGGATAGGCACGCAACTCACDTKTGCCCT | 1097 |
| L6:15 | GCCATTGAGATGATGGATAGGCACCAAACTCACDTKTGCCCT | 1098 |
| L6:16 | GCCATTGAGATGATGGATAGGCACCAAACTCACTATTGCCCT | 1099 |
| L6:17 | AAAAGTATGAGATGTGCTTTACTAAGCCATCGCGATGGAGCA | 1100 |
| L6:18 | AAAGTATGKTTAGGTACACGCTGGACAGAAMAACAWTATGAA | 1101 |
| L6:19 | AAAGTATGKTTAGGTACACGCTGGACAGAAMAAWTGTATGAA | 1102 |
| L6:20 | RSTGCTGAAAATCAATTAGCCTTTTTATGCCAACAAGGTTTT | 1103 |
| L6:21 | TCACTAGAGAATGCATTATATGCARTGAGTGCGTGGRGGGTG | 1104 |
| L6:22 | TCACTAGAGAATGCATTATATGCARTGAGTGCGTGGRGGAAC | 1105 |
| L6:23 | TTTACTTTAGGTTGCGTATTGTTTGATCAAGAGAGCCAAGTC | 1106 |
| L6:24 | GCTAAAGAAGAAAGGGAAACACCTACTACTGCTAGTATGCCG | 1107 |
| L6:25 | CCATTAKTGCGACAAGBTTKGGAATTAAAGGATCACCAAGGT | 1108 |
| L6:26 | CCATTAGCCCGACAAGBTTKGGAATTAAAGGATCACCAAGGT | 1109 |
| L6:27 | GGATTAGAAAAACAACTTAAATGCGAAAGTGGGTCTTAA | 1110 |
| L6:28 | CCTATCCATCATCTCAATGGCTAAGGCGTCGAGCAGAGCTCG | 1111 |
| L6:29 | TTGCCAGCTTTCCCCTTCTAAAGGGCAMAHGTGAGTTTGGTG | 1112 |
| L6:30 | TTGCCAGCTTTCCCCTTCTAAAGGGCAATAGTGAGTTTGGTG | 1113 |
| L6:31 | GCGTGTACCTAAMCATACTTTTGCTCCATCGCGATGGCTTAG | 1114 |
| L6:32 | GGCTAACATATTTTCAGCASYTTCATAWTGTTKTTCTGTCCA | 1115 |
| L6:33 | GGCTAATTGATTTTCAGCASYTTCATAWTGTTKTTCTGTCCA | 1116 |
| L6:34 | GGCTAACATATTTTCAGCASYTTCATACAWTTKTTCTGTCCA | 1117 |
| L6:35 | GGCTAATTGATTTTCAGCASYTTCATACAWTTKTTCTGTCCA | 1118 |
| L6:36 | CAATACGCAACCTAAAGTAAACACCCYCACAGCACTCAYTGC | 1119 |
| L6:37 | CAATACGCAACCTAAAGTAAAGTTCCYCACAGCACTCAYTGC | 1120 |
| L6:38 | TGTTTCCCTTTCTTCTTTAGCGACTTGGCTCTCTTGATCAAA | 1121 |
| L6:39 | CMAAVCTTGTCGCAMTAATGGCGGCATACTAGCAGTAGTAGG | 1122 |
| L6:40 | CMAAVCTTGTCGGGCTAATGGCGGCATACTAGCAGTAGTAGG | 1123 |
| L6:41 | GGGAACTTCGGCGCGCCTTAAGACCCACTTTCGCA | 1124 |

K. Library L7: Shuffling for Enhanced Ethametsulfuron Response

The choice of parents to represent the amino acid residue diversity for library L7 was based on the conclusions of library L4 analysis—namely incorporation of mutations K108Q, C138G and L170V. Clones were also chosen to bring in other changes that occurred at a much lower frequency in L4, but may have been contributing to activity. These residues are L55M, N129H, V137A and F140Y. In addition to family diversity, other residue modifications were introduced at amino acid positions 67, 109, 112, 117, 131 and 173 based on structural modeling. This information is summarized in Table 14 showing L7 diversity summary. Also shown in Table 16 is a sequence alignment the top 10 performing L7 hits limited to the differences between the hits and wt TetR. Activity was determined using image analysis of colony color (ImageJ software) on M9 assay plates containing 0, 0.02 or 0.2 ppm ethametsulfuron. At the bottom of Table 16 is a summary of the sequence-activity relationship analysis for the entire data set derived from more than 300 clones, with the strongly biased positions shown in larger bolded type. Even though some positions were strongly biased, i.e., observed more frequently in the selected population, e.g., M at position 55, the entirety of introduced diversity was observed in the full hit population.

TABLE 16

| Sequence | Amino acid residue position | | | | | | | | | | | | | | | | | | | | | | | | |
|---|---|---|---|---|---|---|---|---|---|---|---|---|---|---|---|---|---|---|---|---|---|---|---|---|---|
| | 55 | 64 | 67 | 85 | 86 | 100 | 104 | 105 | 108 | 109 | 112 | 113 | 116 | 117 | 129 | 131 | 134 | 135 | 137 | 138 | 139 | 140 | 147 | 151 | 170 | 173 | 174 | 177 |
| wt reference | L | H | F | S | F | H | R | P | K | Q | T | L | Q | L | N | L | L | S | V | G | H | F | E | H | L | A | I | F |
| L7 diversity | M L | M Y F L V | | | | | | Q K | M L Q H | S T A G | | | | M L | N H | M L | | | A V | G C | | F Y | | | L A V | G A V | | L K |
| L7-1C03-A05 | M | A | V | I | M | C | G | F | Q | Q | – | A | S | – | H | – | M | Q | A | G | I | – | L | L | V | – | L | N |
| L7-1C07-A06 | M | A | Y | – | M | C | G | F | Q | Q | – | A | S | – | H | – | M | Q | A | G | I | – | L | L | V | – | L | K |
| L7-1F08-A11 | M | A | Y | – | M | C | G | F | Q | Q | – | A | S | – | – | – | M | Q | – | G | I | Y | L | L | V | – | L | K |
| L7-1G06-B02 | M | A | Y | – | M | C | G | F | Q | Q | – | A | S | M | – | – | M | Q | – | G | I | Y | L | L | V | – | L | K |
| L7-2C11-B11 | M | A | Y | – | M | C | G | F | Q | Q | – | A | S | M | – | M | M | Q | A | G | I | – | L | L | V | V | L | K |
| L7-2D08-C02 | M | A | Y | – | M | C | G | F | Q | Q | – | A | S | – | H | – | M | Q | – | G | I | Y | L | L | V | – | L | K |
| L7-3A10-C09 | M | A | Y | – | M | C | G | F | Q | Q | – | A | S | – | H | – | M | Q | – | G | I | Y | L | L | V | – | L | K |
| L7-3C08-C10 | M | A | Y | – | M | C | G | F | Q | Q | G | A | S | M | – | M | M | Q | A | G | I | Y | L | L | V | – | L | K |
| L7-3E03-D01 | M | A | Y | – | M | C | G | F | Q | Q | – | A | S | – | H | M | M | Q | A | G | I | Y | L | L | V | – | L | K |
| L7-3E04-D02 | M | A | Y | – | M | C | G | F | Q | Q | S | A | S | – | H | M | M | Q | A | G | I | – | L | L | V | – | L | K |
| Bias in top population | M | | Y | | | | | | Q | Q | | | | | N | | | | | G | | | | | V | | | |

The L7 library was constructed as for Library L1 using the set of oligonucleotides shown below in Table 17.

TABLE 17

| Oligo ID | Oligo sequence | SEQ ID |
|---|---|---|
| L7:01 | TATTGGCATGTAAAAAATAAGCGAGCTCTGCTCGACGCAWTG | 1125 |
| L7:02 | GCCATTGAGATGCTGGATAGGCACGCGACTCACDTSTGCCCT | 1126 |
| L7:03 | GCCATTGAGATGCTGGATAGGCACGCGACTCACTATTGCCCT | 1127 |
| L7:04 | TTAGAAGGGGAAAGCTGGCAAGATTTTTTACGTAATAACGCT | 1128 |
| L7:05 | AAAAGTATGAGATGTGCTTTACTAAGTCATCGCGATGGAGCA | 1129 |
| L7:06 | AAAGTATGTTTAGGTACAGGCTTTACAGAAMAGMTGTATGAA | 1130 |
| L7:07 | AAAGTATGTTTAGGTACAGGCTTTACAGAAMAGCAMTATGAA | 1131 |
| L7:08 | RSTGCCGAAAATAGTMTGGCCTTTTTATGCCAACAAGGTTTT | 1132 |
| L7:09 | TCACTAGAGMACGCAMTGTATGCAATGCAGGCTGYTKGTATT | 1133 |
| L7:10 | TWTACTTTAGGTTGCGTATTGTTGGATCAAGAGCTTCAAGTC | 1134 |
| L7:11 | GCTAAAGAAGAAAGGGAAACACCTACTACTGATAGTATGCCG | 1135 |
| L7:12 | CCATTAGCTCGACAAGBTCTGGAATTAAAGGATCACCAAGGT | 1136 |
| L7:13 | CCATTASCCGACAAGBTCTGGAATTAAAGGATCACCAAGGT | 1137 |
| L7:14 | GCAGAGCCAGCCTTCTTATTCGGCCTTGAATTGATCATATGC | 1138 |
| L7:15 | GGATTAGAAAAACAACTTAAATGTGAAAGTGGGTCTTAA | 1139 |
| L7:16 | CCTATCCAGCATCTCAATGGCCAWTGCGTCGAGCAGAGCTCG | 1140 |
| L7:17 | TTGCCAGCTTTCCCCTTCTAAAGGGCASAHGTGAGTCGCGTG | 1141 |
| L7:18 | TTGCCAGCTTTCCCCTTCTAAAGGGCAATAGTGAGTCGCGTG | 1142 |
| L7:19 | TAAAGCACATCTCATACTTTTAGCGTTATTACGTAAAAAATC | 1143 |
| L7:20 | GCCTGTACCTAAACATACTTTTGCTCCATCGCGATGACTTAG | 1144 |
| L7:21 | GGCCAKACTATTTTCGGCASYTTCATACAKCTKTTCTGTAAA | 1145 |
| L7:22 | GGCCAKACTATTTTCGGCASYTTCATAKTGCTKTTCTGTAAA | 1146 |
| L7:23 | ATACAKTGCGTKCTCTAGTGAAAAACCTTGTTGGCATAAAAA | 1147 |
| L7:24 | CAATACGCAACCTAAAGTAWAAATACMARCAGCCTGCATTGC | 1148 |
| L7:25 | TGTTTCCCTTTCTTCTTTAGCGACTTGAAGCTCTTGATCCAA | 1149 |
| L7:26 | CAGAVCTTGTCGAGCTAATGGCGGCATACTATCAGTAGTAGG | 1150 |
| L7:27 | CAGAVCTTGTCGGASTAATGGCGGCATACTATCAGTAGTAGG | 1151 |
| L7:28 | GAATAAGAAGGCTGGCTCTGCACCTTGGTGATCCTTTAATTC | 1152 |
| L7:29 | TTTAAGTTGTTTTTCTAATCCGCATATGATCAATTCAAGGCC | 1153 |
| L7:30 | GGGAACTTCGGCGCGCCTTAAGACCCACTTTCACA | 1154 |

After transformation of the library into *E. coli* KM3 and plating on LB+Cb+Km the resulting colonies were reformatted into fifty-two 384-well microtiter plates (~20,000 colonies) and subsequently used to replica plate onto M9 assay medium containing either 0 μg/ml, 0.02 μg/ml or 0.2 μg/ml ethametsulfuron. After incubation at 30° C. for 48 hrs the plates were observed and 326 hits responding to 0.02 μg/ml inducer were identified and re-arrayed into 96-well format. Following incubation at 30° C. for 15, 24, 48 and 120 hours, digital images of the plates were taken and the relative colony color information converted to numerical data. DNA sequence analysis was carried out in parallel, and the two data sets merged for calculation of sequence-activity relationships. Sequence data for the top ten clones as well as the summary of the sequence-activity relationships are shown in Table 16. The results of sequence-activity relationship study revealed preferences impacting both activation and background activities of the putative ethametsulfuron repressors (EsR's). For example, one significant finding from this library was that modification L55M greatly reduced background activity and thus enhanced levels of fold activation. As seen from libraries L4 and L6, K108Q and wt Q109 were preferred for activation. There was also a high degree of bias towards L170V related to activation. This is different from the L170A or L170G bias seen in library L6, as those modifications had a strong correlation with lowering background activity in library L6. Finally, having a less dramatic effect on activation but nevertheless preferred is F67Y.

L. Induction Properties of Top L7 Hits in Liquid Cultures

Figure 5:
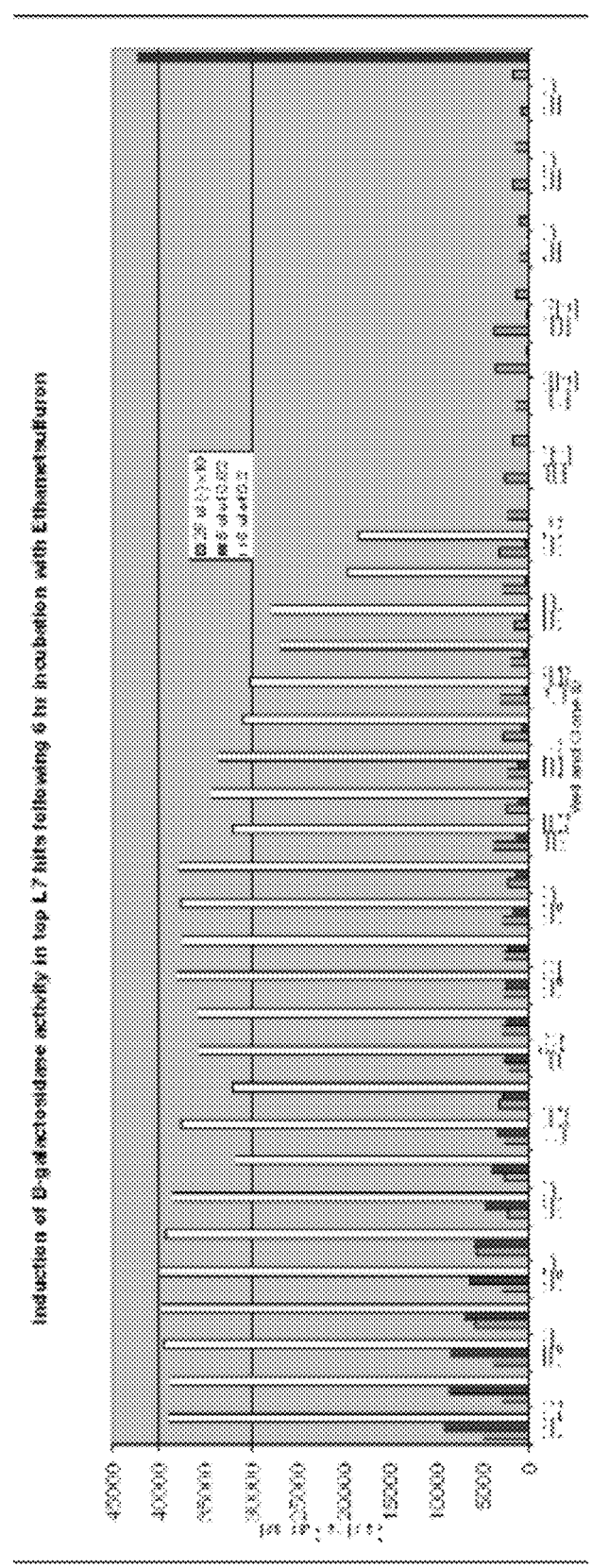
FIG. 5. β-galactosidase induction in L7 hits with ethametsulfuron. Top hits from the L7 library were re-arrayed and tested in 96-well culture format for relative induction by 0.02 μg/ml and 0.2 μg/ml inducer (Es), and for background activity in the absence of inducer. Induced activity was assayed using 5 μl of perforated cell mixture, whereas 25 μl of cells was used to detect background activity. This allowed all detectable activities to be measured in the same time frame for all treatments. Background activity values were multiplied by ten to bring them into the range of the graph. The latter part of the graph shows the controls: 2nd round hits L4-89 and L4-120, and wt TetR(B) with ethametsulfuron; and wt TetR with 0.4 μM atc as cognate inducer for comparison (diagonally striped bar). Well ID's indicated with slanted text refer to that of the assay re-array whereas original clone ID's are indicated below in horizontal text.

Based on the performance of the re-arrayed hits, a second re-array was done and the clones tested for β-galactosidase activity in liquid culture along with wt TetR controls and selected $2^{nd}$ round hits to further analyze their performance and shuffling progress. Top hits from the L7 library were re-arrayed and tested in 96-well culture format for relative induction by 0.02 and 0.2 ug/ml inducer or background activity without inducer (FIG. 5). Cultures were grown overnight and then subcultured into fresh medium containing appropriate treatments. Following six hours of incubation the cells were processed for enzyme assay. For assay of induced activity 5 μl of perforated cell mixture was used, for background activity 25 μl of cells were used such that detectable activity could be measured in the same time frame for all treatments. Background activity values were multiplied by ten to bring them into the range of the graph. The numbers below each sample refers to the final re-array well ID (vertical writing) and original re-array well ID (horizontal writing). The latter part of the graph contains the controls. Shown are 2nd round hits L4-89 and L4-120 as well as wt TetR. The final sample shows a control comprising wt TetR with 0.4 μM atc as cognate inducer for comparison. Results show that ten to fifteen of the top hits have induced activity approaching that of wt TetR induced with 0.4 μM atc. In addition, many of the hits have background activities nearly as low as wild type TetR. Some of the best hits have induction ratios with 0.2 ppm inducer (0.5 μM) approaching 70-80% of that of wt TetR (~1200-fold). It is interesting that the hits performing best at the low inducer concentration of 0.02 ppm (50 nM) also tended to have the higher background activity indicating that they are less tightly bound to tet operator and more easily released with transient inducer binding.

Comparison of induction activity between the $2^{nd}$ and $3^{rd}$ round hits is striking, showing greater than 200-fold improvement. Considering this improvement, a single additional round of shuffling and screening may yield sulfonylurea repressors (SuRs) that are nearly as sensitive to ethametsulfuron as the wt TetR is for tetracycline.

Summary

FIG. 9 provides a cumulative summary of the introduced diversity and observed amino acids in active SuRs obtained from the screening assays. Even though some positions were strongly biased i.e., observed more frequently in the selected population, as indicated by larger bolded type, the entirety of introduced diversity was observed in the full hit populations.

M. Novel Diversity Through In Vitro Mutagenesis

Residues A64, M86, C100, G104, F105, Q108, A113, S116, M134, Q135, I139, Y140, L147, L151, V170, L174, and K177 of round 3 hit L7-A11 were each mutagenized to all possible 20 amino acids to generate a set of 340 clones. Each of the clones was replica plated onto M9 assay medium containing 0, 5, 20 and 200 ppb ethametsulfuron. To assess relative activity of each of the mutants the plates containing ligand were photographed following 18 hrs of incubation at 37° C. To determine leakiness of the repressor clones the plate having no ligand addition was photographed after incubation for 24 hrs at 37° C. followed by 48 hrs of incubation at 25° C. Quantitative measurements were made by scanning digital photographs of each colony for blue color using ImageJ software.

These data revealed that select substitutions at positions L60, A64, N82, M86, A113, S116, M134, L174, and K177 demonstrated an increase in ethametsulfuron sensitivity relative to the parent clone L7-A11.

N. Fifth-Round Shuffling

Shuffling designed for improved ethametsulfuron sensitivity was performed. Library L13 (Table 18) was designed to incorporate novel diversity generated by the in vitro mutagenesis experiment in Example 1M that had either positive or neutral effect on activity. In addition, the library also incorporated diversity at selected cysteine residues in the backbone as listed (Table 18). The predicted library size is 124,000 members.

TABLE 18

| | Library L13 | | | | | | | | | | | | | | |
|---|---|---|---|---|---|---|---|---|---|---|---|---|---|---|---|
| Residue | 60 | 64 | 68 | 82 | 86 | 88 | 100 | 113 | 116 | 121 | 134 | 174 | 177 | 195 | 203 |
| L7-A11 | L | A | C | N | M | C | C | A | S | C | M | L | K | C | C |
| Diversity | L | A | L | K | M | N | C | A | S | T | M | L | K | C | C |
| | F | D | C | R | R | | A | M | C | | F | I | H | S | A |
| | | K | | N | | | | | W | | G | F | R | | |
| | | | | | | | | | | | | Y | | | |

The library was assembled from synthetic oligonucleotides listed in Table 19 using methodology as described previously in this example.

TABLE 19

| Oligo | Sequence | SEQ ID |
|---|---|---|
| L13:1 | TGGCACGTCAAGAACAAGCGAGCTCTGCTAGACGCTATGGCC | 1159 |
| L13:2 | ATTGAGATGTTSGATAGGCACAAGACCCACTACTGTCCTTTG | 1160 |
| L13:3 | ATTGAGATGTTSGATAGGCACAAGACCCACTACCTGCCTTTG | 1161 |
| L13:4 | ATTGAGATGTTSGATAGGCACGMCACCCACTACTGTCCTTTG | 1162 |
| L13:5 | ATTGAGATGTTSGATAGGCACGMCACCCACTACCTGCCTTTG | 1163 |
| L13:6 | GAAGGGGAAAGCTGGCAAGACTTCTTGAGGAACAATGCTAAG | 1164 |
| L13:7 | GAAGGGGAAAGCTGGCAAGACTTCTTGAGGAACARGGCTAAG | 1165 |
| L13:8 | TCCAKGAGAAATGCTTTGCTCAGTCACCGTGATGGAGCCAAG | 1166 |
| L13:9 | GTCTGCCTAGGTACGGGCTTCACGGAGCAACAGTATGAAACT | 1167 |
| L13:10 | GTCGCTCTAGGTACGGGCTTCACGGAGCAACAGTATGAAACT | 1168 |
| L13:11 | GCTGAGAACTSKCTTGCCTTCCTGACACAACAAGGTTTCTCC | 1169 |
| L13:12 | ATGGAGAACTSKCTTGCCTTCCTGACACAACAAGGTTTCTCC | 1170 |
| L13:13 | CTTGAGAACGCCCTCTACGCATTTCAAGCTGTTGGGATCTAC | 1171 |
| L13:14 | CTTGAGAACGCCCTCTACGCAGGTCAAGCTGTTGGGATCTAC | 1172 |
| L13:15 | CTTGAGAACGCCCTCTACGCAATGCAAGCTGTTGGGATCTAC | 1173 |
| L13:16 | ACTCTGGGTTGCGTCTTGCTGGATCAAGAGCTGCAAGTCGCT | 1174 |
| L13:17 | AAGGAGGAGAGGGAAACACCTACTACTGATAGTATGCCGCCA | 1175 |
| L13:18 | CTGGTTCGACAAGCTTACGAACTCCACGATCACCAAGGTGCA | 1176 |
| L13:19 | CTGGTTCGACAAGCTTACGAACTCARAGATCACCAAGGTGCA | 1177 |
| L13:20 | CTGGTTCGACAAGCTHTCGAACTCCACGATCACCAAGGTGCA | 1178 |
| L13:21 | CTGGTTCGACAAGCTHTCGAACTCARAGATCACCAAGGTGCA | 1179 |
| L13:22 | GAGCCAGCCTTCCTGTTCGGCCTTGAACTGATCATAWGTGGA | 1180 |
| L13:23 | TTGGAGAAGCAGCTGAAGTGTGAAAGTGGGTCTTAATGATAG | 1181 |
| L13:24 | TTGGAGAAGCAGCTGAAGGCAGAAAGTGGGTCTTAATGATAG | 1182 |
| L13:25 | GTGCCTATCSAACATCTCAATGGCCATAGCGTCTAGCAGAGC | 1183 |
| L13:26 | GTCTTGCCAGCTTTCCCCTTCCAAAGGACAGTAGTGGGTCTT | 1184 |
| L13:27 | GTCTTGCCAGCTTTCCCCTTCCAAAGGCAGGTAGTGGGTCTT | 1185 |
| L13:28 | GTCTTGCCAGCTTTCCCCTTCCAAAGGACAGTAGTGGGTGKC | 1186 |
| L13:29 | GTCTTGCCAGCTTTCCCCTTCCAAAGGCAGGTAGTGGGTGKC | 1187 |
| L13:30 | GAGCAAAGCATTTCTCMTGGACTTAGCATTGTTCCTCAAGAA | 1188 |
| L13:31 | GAGCAAAGCATTTCTCMTGGACTTAGCCYTGTTCCTCAAGAA | 1189 |
| L13:32 | GAAGCCCGTACCTAGGCAGACCTTGGCTCCATCACGGTGACT | 1190 |
| L13:33 | GAAGCCCGTACCTAGAGCGACCTTGGCTCCATCACGGTGACT | 1191 |
| L13:34 | GAAGGCAAGMSAGTTCTCAGCAGTTTCATACTGTTGCTCCGT | 1192 |
| L13:35 | GAAGGCAAGMSAGTTCTCCATAGTTTCATACTGTTGCTCCGT | 1193 |
| L13:36 | TGCGTAGAGGGCGTTCTCAAGGGAGAAACCTTGTTGTGTCAG | 1194 |
| L13:37 | CAGCAAGACGCAACCCAGAGTGTAGATCCCAACAGCTTGAAA | 1195 |
| L13:38 | CAGCAAGACGCAACCCAGAGTGTAGATCCCAACAGCTTGACC | 1196 |
| L13:39 | CAGCAAGACGCAACCCAGAGTGTAGATCCCAACAGCTTTGCAT | 1197 |
| L13:40 | AGGTGTTTCCCTCTCCTCCTTAGCGACTTGCAGCTCTTGATC | 1198 |
| L13:41 | TTCGTAAGCTTGTCGAACCAGTGGCGGCATACTATCAGTAGT | 1199 |
| L13:42 | TTCGADAGCTTGTCGAACCAGTGGCGGCATACTATCAGTAGT | 1200 |
| L13:43 | GCCGAACAGGAAGGCTGGCTCTGCACCTTGGTGATCGTGGAG | 1201 |
| L13:44 | GCCGAACAGGAAGGCTGGCTCTGCACCTTGGTGATCTYTGAG | 1202 |
| L13:45 | ACACTTCAGCTGCTTCTCCAATCCACWTATGATCAGTTCAAG | 1203 |
| L13:46 | TGCCTTCAGCTGCTTCTCCAATCCACWTATGATCAGTTCAAG | 1204 |
| L13:47 | GCGCCAAGGTACCTTCTGCAGCTATCATTAAGACCCACTTTC | 1205 |

Figure 11:
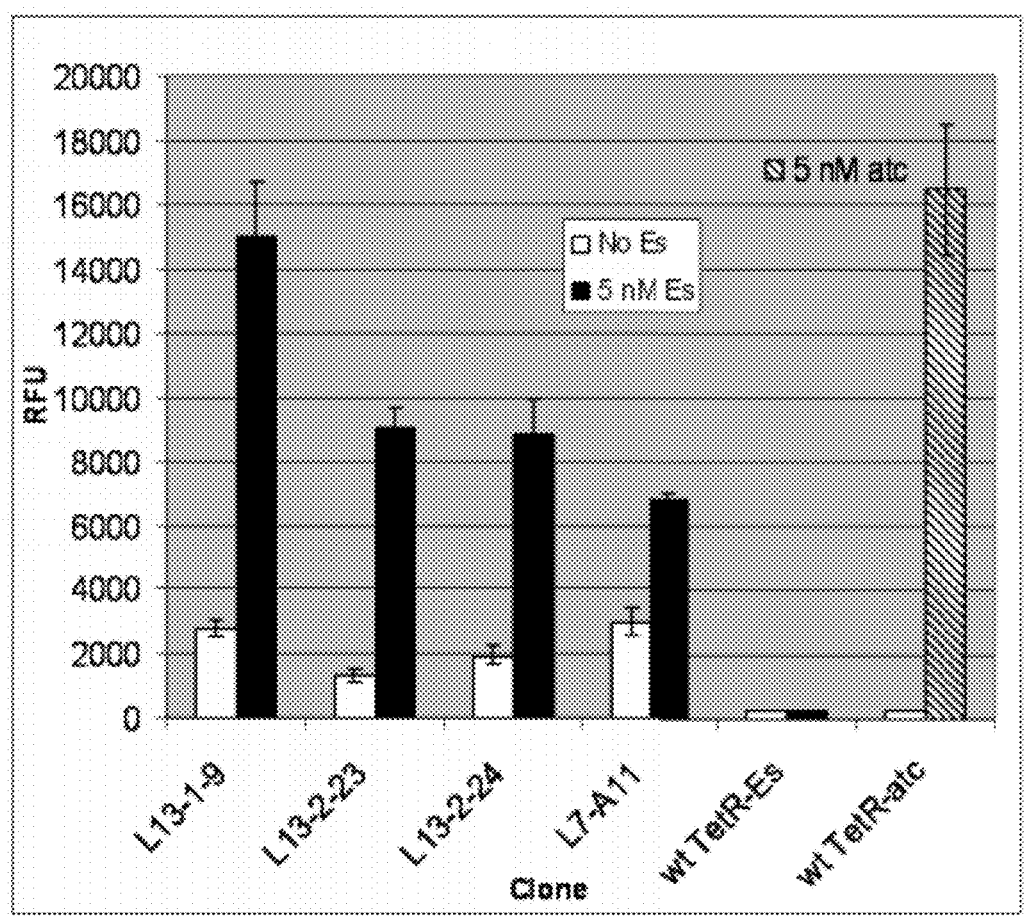
FIG. 11. β-galactosidase induction in exemplary L13 hits with ethametsulfuron.

The assembled library was then cloned into pVER7571. This vector is the same as vector pVER7314 except for having a mutated ribosome binding site to reduce the amount of repressor produced per cell. This modification allows for more stringent assessment of repressor activity in the standard blue/white genetic plate assay, as well as in the liquid based whole cell quantitative β-galactosidase assay. Following plating of the library, approximately 5,000 clones were re-arrayed and replica plated onto M9 assay plates with no addition, or with 2 ppb ethametsulfuron plus 0.002% arabinose. Colonies responding the strongest with ethametsulfuron while remaining white without inducer were chosen as hits. One of the hits, L13-23, was found to be ~3-fold improved over the round 3 parent L7-A11 and to have the best repressor activity within this comparison (FIG. 11). Sequence changes of the round 5 hit compared to parent molecule L7-A11 and wt TetR are shown in Table 20.

B. High Throughput in Planta Assay Development Using *N. tabacum* BY-2 Cell Culture In addition to the leaf assay it was desired to have an in planta assay to enable high throughput screening of SuR libraries for optimal plant functionality. We designed a system similar to the leaf assay but using tobacco BY-2 cell culture in 96-well format. BY-2 cell culture was transformed with a dMMV-HRA construct such that the culture would withstand treatment with target sulfonylurea test compounds. The resultant cell line grows and is fully resistant to 200 ppb chlorsulfuron.

TABLE 20

| Clone wt | 55 L | 60 L | 64 H | 67 F | 68 C | 82 N | 86 F | 88 C | 100 H | 104 R | 105 P | 108 K | 113 L | 116 Q | 121 C | 134 L | 135 S | 139 H | 140 F | 147 E | 151 H | 170 L | 174 I | 177 F | 195 C | 203 C |
|---|---|---|---|---|---|---|---|---|---|---|---|---|---|---|---|---|---|---|---|---|---|---|---|---|---|---|
| L7-A11 | M | – | A | Y | – | – | M | – | C | G | F | Q | A | S | – | M | Q | I | Y | L | L | V | L | K | – | – |
| L13-1-09 | M | – | A | Y | – | K | M | N | A | G | F | Q | M | S | T | F | Q | I | Y | L | L | V | Y | K | – | A |
| L13-2-23 | M | F | A | Y | – | K | M | N | A | G | F | Q | A | C | T | F | Q | I | Y | L | L | V | Y | K | – | – |
| L13-2-24 | M | – | K | Y | L | – | M | N | C | G | F | Q | A | W | T | F | Q | I | Y | L | L | V | L | H | S | A |

Example 2

Plant Assay Development

A. *Nicotiana benthamiana* Leaf Infiltration Assay:

An in planta transient assay system was desired to rapidly confirm functionality of candidate SU-responsive repressors in planta prior to testing in transgenic plants. Therefore, an *Agrobacterium* based leaf infiltration assay was developed to measure repression and derepression activities. The strategy employed is to infiltrate leaves with a mixture of reporter and effector (repressor) *Agrobacterium* strains such that reporter activity is reduced by ~90% in the presence of the effector and then derepressed following treatment with inducer.

Figure 6:
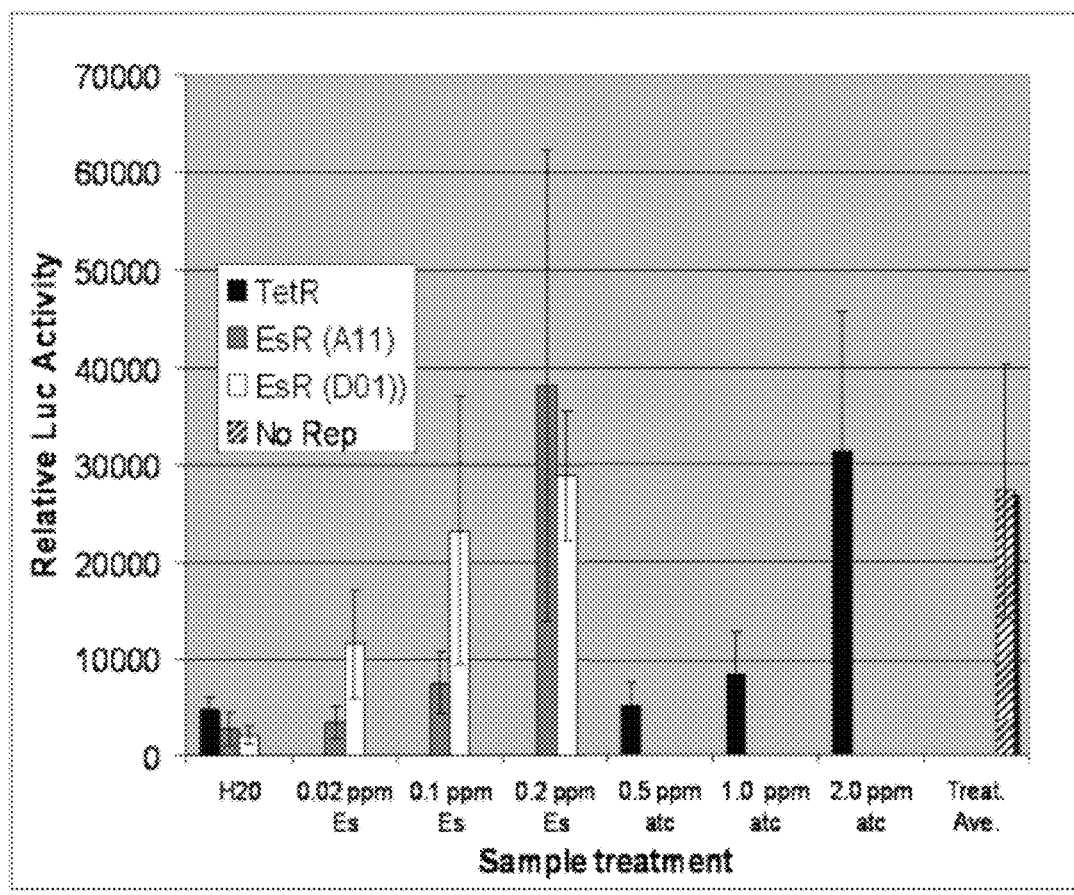
FIG. 6. Ethametsulfuron dose response of two EsR variants determined by transient expression in *Nicotiana benthamiana* leaves. Black bars represent wt TetR, grey bars represent EsR hit A11, and white bars represent EsR hit D01. The striped bar represents a no repressor control which indicates the maximum level of reporter expression in the assay.

Two ethametsulfuron repressors, EsR A11 and EsR D01, were selected for testing in conjunction with a wild type TetR control for dose response to ethametsulfuron by transient expression in *Nicotiana benthamiana* leaves (FIG. 6). To this end, three test strains were derived by transformation of *Agrobacterium tumefaciens* EHA105 with three different T-DNA based vectors. *Agrobacterium* strains harboring binary vectors with a 35S::tetO-*Renilla* Luciferase reporter and dPCSV-tetR or -SuR effector variants were constructed. In addition to these tester cultures, an existing *Agrobacterium* strain harboring a dMMV-GFP T-DNA was added to the assay mixture to monitor the progression of *Agrobacterium* infection for sampling purposes.

To test the system for chemical switch activation, mixtures of tester *Agrobacterium* cultures containing 10% 35S::tetO-ReLuc reporter Agro, 10% dMMV-GFP Agro and 80% dPCSV-wt tetR Agro were infiltrated into *N. benthamiana* leaves and co-cultivated for 36 hours in the growth chamber. At this time the infiltrated leaves were excised and the petiole placed into water (negative control) or inducer at the test concentrations indicated in FIG. 6 and allowed to co-cultivate for another 36 hours. Infected leaf areas were assayed for *Renilla* luciferase activity and inducer treatments compared. The results show significant repression of reporter activity (~90%) with no inducer treatment (water control) for all tested repressors, and significant but incomplete induction of the EsR D01 repressor at inducer concentration as low as 0.02 ppm Es. Both EsR's were fully induced at 0.2 ppm Es whereas TetR was only fully induced at 2.0 ppm anhydrotetracycline (atc) (FIG. 6).

Example 3

Operator Binding Assay

To confirm that sulfonylurea ligands were binding directly to the modified repressor molecules and causing derepression, an in vitro tet operator gel shift study was undertaken.

An electrophoretic gel mobility shift assay (EMSA) of EsR variants was done to monitor binding to the tet operator (tetO) sequence and response of the complex to inducers Es and Cs. TetO consists of a synthetic 48 by tetO-containing fragment created from hybridization of oligonucleotide tetO1 (SEQ ID NO: 1155): 5'-CCTAATTTTTGTTGACACTCTATCAT-TGATAGAGTTATTTTACCACTC-3' and complementary oligonucleotide tetO2 (SEQ ID NO: 1156): 5'-GGAT-TAAAAACAACTGTGAGATAGTAAC-TATCTCAATAAAATGGTGAG-3' The tet operator is shown in bold.

An oligonucleotide and its complement of the same size containing no palindromic sequence was used as a control (SEQ ID NO: 1157): 5'-CCTAATTTTTGTTGACTGTGT-TAGTCCATAGCTGGTATTTTACCACTC-3' and complementary oligonucleotide (SEQ ID NO: 1158): 5'-G GAT-TAAAAACAACTGACACAATCAGGTATCGACCATAA AATGGTGAG-3'

Five pmol of TetO or control DNA was mixed with the indicated amounts (FIG. 7) of ethametsulfuron repressor protein (L7A11) or BSA control with or without inducer in complex buffer containing 20 mM Tris-HCl (pH8.0) and 10 mM EDTA. The mixture was incubated at room temperature for 0.5 hour before loading onto the gel. The reaction was electrophoresed on a Novex 6% DNA retardation gel (Invitrogen, EC6365BOX) at room temperature, 38 V in 0.5×TBE buffer for about 2 hours. DNA was detected by ethidium bromide staining. The DNA size marker consists of the low DNA mass ladder (InVitrogen 10068-013).

Figure 7:
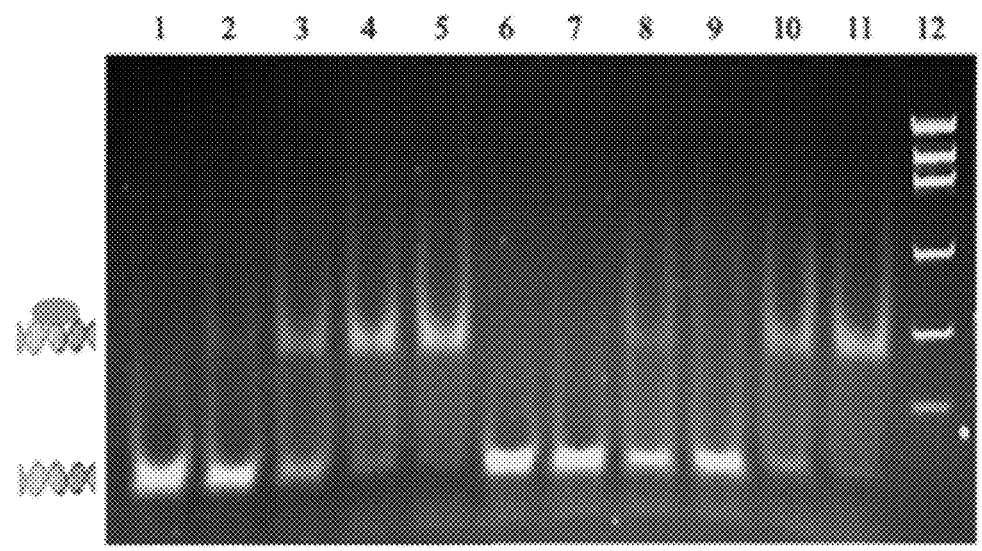
FIG. 7. DNA binding to tetOp in the absence or presence of ligand. Five pmol TetO or control DNA was mixed with the indicated amounts of repressor protein and inducer in complex buffer containing 20 mM Tris-HCl (pH8.0) and 10 mM EDTA.
Figure 8:
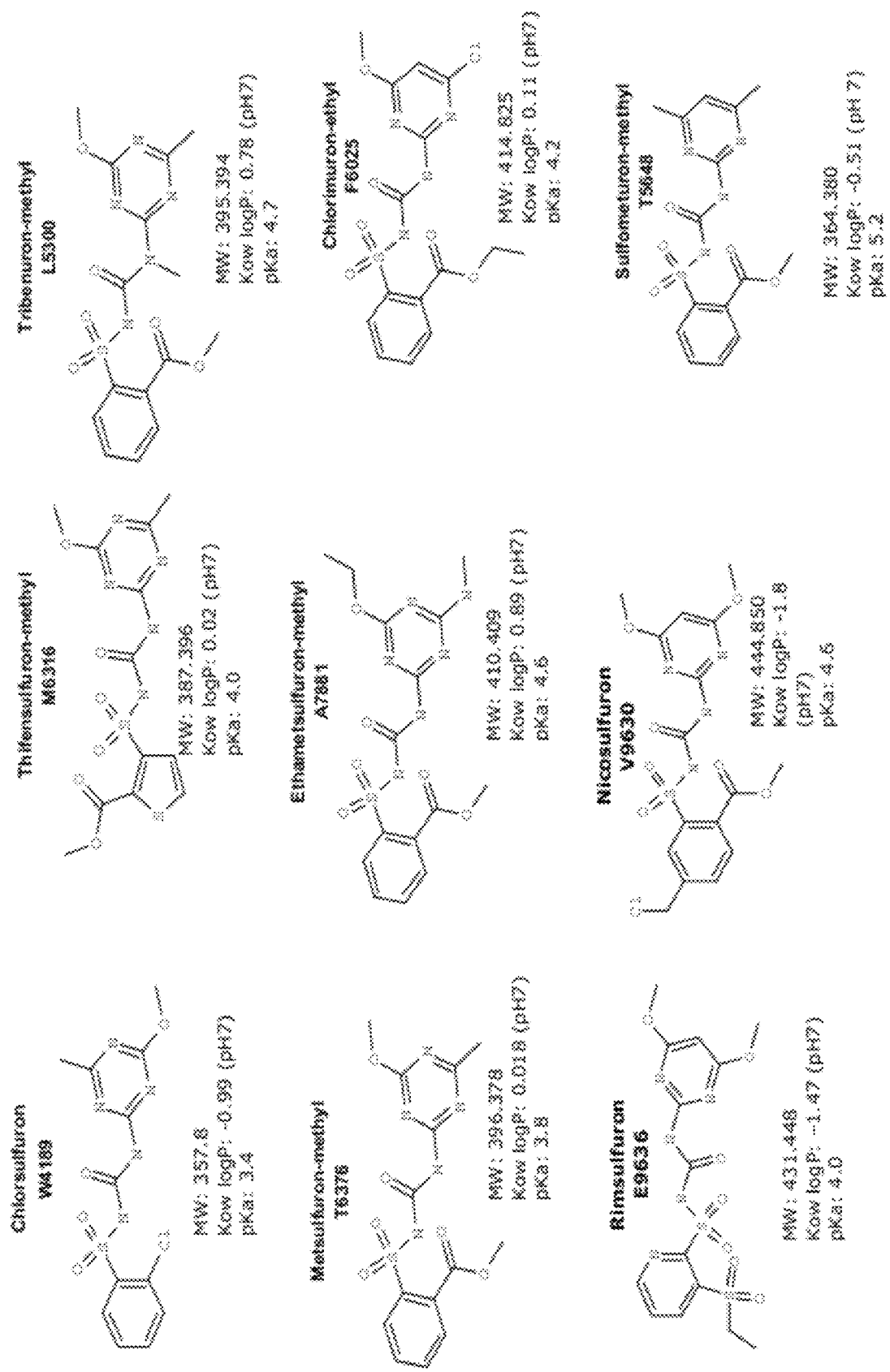
FIG. 8. Structures of exemplary registered sulfonylurea compounds.

The results are shown in FIG. 7. These results directly demonstrate that the modified repressors bind to operator DNA (lane 1 vs. lanes 3-5) and then are released from the operator sequence in an inducer-specific and dose dependent manner. The data also indicate an inducer preference for operator release by Es compared to Cs (lane 9 vs. 10). No change in operator release could be detected by atc compared to no inducer (lane 5 vs. 11).

Example 4

Binding and Dissociation Constants

Select SU repressors were further characterized for operator and ligand binding, affinity and dissociation kinetics using Biacore™ SPR technology (Biacore, GE Healthcare, USA). The technology is based on surface plasmon resonance (SPR), an optical phenomenon that enables detection of unlabeled interactants in real time. The SPR-based biosensors can be used in determination of active concentration, screening and characterization in terms of both affinity and kinetics.

The kinetics of an interaction, i.e., the rates of complex formation ($k_a$) and dissociation ($k_d$), can be determined from the information in a sensorgram. If binding occurs as sample passes over a prepared sensor surface, the response in the sensorgram increases. If equilibrium is reached, a constant signal is seen. Replacing the sample with buffer causes the bound molecules to dissociate and the response decreases. Biacore evaluation software generates the values of $k_a$ and $k_d$ by fitting the data to interaction models.

The affinity of an interaction is determined from the level of binding at equilibrium (seen as a constant signal) as a function of sample concentration. Affinity can also be determined from kinetic measurements. For a simple 1:1 interaction, the equilibrium constant $K_D$ is the ratio of the kinetic rate constants, $k_d/k_a$.

A. Operator Binding Characterization of Repressors

| Repressor | $k_a$ (M$^{-1}$ s$^{-1}$) | $K_d$ (s$^{-1}$) | $K_D$ (nM) |
|---|---|---|---|
| Wt TetR | $3.3 \times 10^5$ | $3.0 \times 10^{-3}$ | $9.0 \pm 1.0$ |
| L7-1C03-A5 | $4.7 \times 10^4$ | $7.8 \times 10^{-3}$ | $150 \pm 5$ |
| L7-3E03-D1 | $5.5 \times 10^4$ | $1.1 \times 10^{-2}$ | $200 \pm 50$ |
| L7-1F08-A11 | $7.1 \times 10^4$ | $1.7 \times 10^{-2}$ | $250 \pm 120$ |
| L7-1G06-B2 | $4.6 \times 10^4$ | $1.9 \times 10^{-2}$ | $430 \pm 160$ |

B. SU Binding Characterization of Repressors

| Repressor | KD (M) | | | | |
|---|---|---|---|---|---|
| | Es +Mg | Es −Mg | Cs +Mg | Cs −Mg | ATC +Mg |
| L7-1C03-A5 | 0.46 | 1.78 | 83 | 365 | Null |
| L7-1F08-A11 | 0.45 | 1.09 | 40 | 92 | Null |
| L7-1G06-B2 | 0.53 | 2.15 | 60 | 255 | Null |
| L7-3E03-D1 | 0.73 | 2.15 | 48 | 115 | Null |
| Wt TetR | Null | Null | Null | Null | 0.0036 |

Example 5

Sulfonylurea Repressor Ligand-Binding Domain Fusions

The ligand binding domains from the sulfonylurea repressors provided herein can be fused to alternative DNA binding domains in order to create further sulfonylurea repressors that selectively and specifically bind to other DNA sequences (e.g., Wharton and Ptashne (1985) *Nature* 316:601-605). Many domain swapping experiments have been published, demonstrating the breadth and flexibility of this approach. Generally, an operator binding domain or specific amino acid/operator contact residues from a different repressor system will be used, but other DNA binding domains can also be used. For example, a polynucleotide encoding a TetR(D)/SuR chimeric polypeptide consisting of the DNA binding domain from TetR(D) (e.g., amino acid residues 1-50) and ligand binding domain of a SuR residues (e.g., amino acid residues 51-208 from TetR(B) can be constructed using any standard molecular biology method or combination thereof, including restriction enzyme digestion and ligation, PCR, synthetic oligonucleotides, mutagenesis or recombinational cloning. For example, a polynucleotide encoding a SuR comprising a TetR(D)/SuR chimera can be constructed by PCR (Landt et al. (1990) *Gene* 96:125-128; Schnappinger et al. (1998) *EMBO J* 17:535-543) and cloned into a suitable expression cassette and vector. Any other TetOp binding domains can be substituted to produce a SuR that specifically binds to the cognate tet operator sequence.

In addition, mutant TetO$^c$ binding domains from variant TetR's having suppressor activity on constitutive operator sequences (tetO-4C and tetO-6C) can be used (see, e.g., Helbl and Hillen (1998) *J Mol Biol* 276:313-318; and Helbl et al. (1998) *J Mol Biol* 276:319-324). Further, the polynucleotides encoding these DNA binding domains can be modified to change their operator binding properties. For example, the polynucleotides can be shuffled to enhance the binding strength or specificity to a wild type or modified tet operator sequence, or to select for specific binding to a new operator sequence.

Additional variants could be made by fusing an SuR repressor, or an SuR ligand binding domain to an activation domain. Such systems have been developed using Tet repressors. For example, one system converted a tet repressor to an activator via fusion of the repressor to a transcriptional transactivation domain such as herpes simplex virus VP16 and the tet repressor (tTA, Gossen and Bujard (1992) Proc Natl Acad Sci USA 89:5547-5551). The repressor fusion is used in conjunction with a minimal promoter which is activated in the absence of tetracycline by binding of tTA to tet operator sequences. Tetracycline inactivates the transactivator and inhibits transcription.

Example 6

Testing of Repressor Proteins in Soybean

Any transformation protocols, culture techniques, soybean source, and media, and molecular cloning techniques can be used with the compositions and methods.

A Transformation and Regeneration of Soybean (*Glycine max*)

Transgenic soybean lines are generated by the method of particle gun bombardment (Klein et al. Nature 327:70-73 (1987); U.S. Pat. No. 4,945,050) using a BIORAD Biolistic PDS1000/He instrument and either plasmid or fragment DNA. The following stock solutions and media are used for transformation and regeneration of soybean plants:

Stock Solutions:
Sulfate 100× Stock: 37.0 g MgSO4.7H2O, 1.69 g MnSO4.H2O, 0.86 g ZnSO4.7H2O, 0.0025 g CuSO4.5H2O
Halides 100× Stock: 30.0 g CaCl2.2H2O, 0.083 g KI, 0.0025 g CoCl2.6H2O
P, B, Mo 100× Stock: 18.5 g KH2PO4, 0.62 g H3BO3, 0.025 g Na2MoO4.2H2O Fe EDTA 100× Stock: 3.724 g Na2EDTA, 2.784 g FeSO4.7H2O 2,4-D Stock: 10 mg/mL 2,4-Dichlorophenoxyacetic acid B5 vitamins, 1000× Stock: 100.0 g myo-inositol, 1.0 g nicotinic acid, 1.0 g pyridoxine HCl, 10 g thiamine.HCL.

Media (Per Liter):

SB199 Solid Medium: 1 package MS salts (Gibco/BRL, Cat. No. 11117-066), 1 mL B5 vitamins 1000× stock, 30 g Sucrose, 4 ml 2, 4-D (40 mg/L final concentration), pH 7.0, 2 g Gelrite SB1 Solid Medium: 1 package MS salts (Gibco/BRL, Cat. No. 11117-066), 1 mL B5 vitamins 1000× stock, 31.5 g Glucose, 2 mL 2, 4-D (20 mg/L final concentration), pH 5.7, 8 g TC agar SB196: 10 mL of each of the above stock solutions 1-4, 1 mL B5 Vitamin stock, 0.463 g (NH4)2 SO4, 2.83 g KNO3, 1 mL 2,4 D stock, 1 g asparagine, 10 g sucrose, pH 5.7

SB71-4: Gamborg's B5 salts, 20 g sucrose, 5 g TC agar, pH 5.7.

SB103: 1 pk. Murashige & Skoog salts mixture, 1 mL B5 Vitamin stock, 750 mg MgCl2 hexahydrate, 60 g maltose, 2 g gelrite, pH 5.7.

SB166: SB103 supplemented with 5 g per liter activated charcoal.

Soybean Embryogenic Suspension Culture Initiation:

Soybean cultures are initiated twice each month with 5-7 days between each initiation. Pods with immature seeds from available soybean plants 45-55 days after planting are picked, removed from their shells and placed into a sterilized magenta box. The soybean seeds are sterilized by shaking them for 15 min in a 5% Clorox solution with 1 drop of ivory soap (i.e., 95 mL of autoclaved distilled water plus 5 mL Clorox and 1 drop of soap, mixed well). Seeds are rinsed using 2 1-liter bottles of sterile distilled water and those less than 3 mm are placed on individual microscope slides. The small end of the seed is cut and the cotyledons pressed out of the seed coat. Cotyledons are transferred to plates containing SB199 medium (25-30 cotyledons per plate) for 2 weeks, then transferred to SB1 for 2-4 weeks. Plates are wrapped with fiber tape. After this time, secondary embryos are cut and placed into SB196 liquid media for 7 days.

Culture Conditions:

Soybean embryogenic suspension cultures (cv. Jack) are maintained in 50 mL liquid medium SB196 on a rotary shaker, 150 rpm, 26° C. with cool white fluorescent lights on 16:8 h day/night photoperiod at light intensity of 60-85 µE/m2/s. Cultures are subcultured every 7 days to two weeks by inoculating approximately 35 mg of tissue into 50 mL of fresh liquid SB196 (the preferred subculture interval is every 7 days).

Preparation of DNA for Bombardment:

In particle gun bombardment procedures it is possible to use purified intact plasmid DNA; or DNA fragments containing only the recombinant DNA expression cassette(s) of interest. For every seventeen bombardment transformations, 85 µL of suspension is prepared containing 1 to 90 picograms (pg) of plasmid DNA per base pair of each DNA plasmid. Both recombinant DNA plasmids are co-precipitated onto gold particles as follows. The DNAs in suspension are added to 50 µL of a 10-60 mg/mL 0.6 µm gold particle suspension and then combined with 50 µL CaCl2 (2.5 M) and 20 µL spermidine (0.1 M). The mixture is vortexed for 5 sec, spun in a microfuge for 5 sec, and the supernatant removed. The DNA coated particles are then washed once with 150 µL of 100% ethanol, vortexed and pelleted, then resuspended in 85 µL of anhydrous ethanol. Five µL of the DNA coated gold particles are then loaded on each macrocarrier disk.

Tissue Preparation and Bombardment with DNA:

Approximately 150 to 250 mg of two-week-old suspension culture is placed in an empty 60 mm×15 mm petri plate and the residual liquid removed from the tissue using a pipette. The tissue is placed about 3.5 inches away from the retaining screen and each plate of tissue is bombarded once. Membrane rupture pressure is set at 650 psi and the chamber is evacuated to −28 inches of Hg. Following bombardment, the tissue from each plate is divided between two flasks, placed back into liquid media, and cultured as described above.

Selection of Transformed Embryos and Plant Regeneration:

After bombardment, tissue from each bombarded plate is divided and placed into two flasks of SB196 liquid culture maintenance medium per plate of bombarded tissue. Seven days post bombardment, the liquid medium in each flask is replaced with fresh SB196 culture maintenance medium supplemented with 100 ng/ml selective agent (selection medium). Transformed soybean cells can be selected using a sulfonylurea (SU) compound such as 2 chloro N ((4 methoxy 6 methy 1,3,5 triazine 2 yl)aminocarbonyl)benzenesulfonamide (common names: DPX-W4189 and chlorsulfuron). Chlorsulfuron (Cs) is the active ingredient in the DuPont sulfonylurea herbicide, GLEAN®. The selection medium containing SU is replaced every two weeks for 6-8 weeks. After the 6-8 week selection period, islands of green, transformed tissue are observed growing from untransformed, necrotic embryogenic clusters. These putative transgenic events are isolated and kept in SB196 liquid medium with Cs at 100 ng/ml for another 2-6 weeks with media changes every 1-2 weeks to generate new, clonally propagated, transformed embryogenic suspension cultures. Embryos spend a total of around 8-12 weeks in contact with Cs. Suspension cultures are subcultured and maintained as clusters of immature embryos and also regenerated into whole plants by maturation and germination of individual somatic embryos.

Somatic embryos became suitable for germination after four weeks on maturation medium (1 week on SB166 followed by 3 weeks on SB103). They are then removed from the maturation medium and dried in empty petri dishes for up to seven days. The dried embryos are then planted in SB71 4 medium where they are allowed to germinate under the same light and temperature conditions as described above. Germinated embryos are transferred to potting medium and grown to maturity for seed production.

B. Vector Construction and Testing

Plasmids were made using standard procedures and from these plasmids DNA fragments were isolated using restriction endonucleases and agarose gel purification according to the protocol described in Example 6A. Each DNA fragment contained three cassettes. Cassette 1 is a reporter expression cassette; Cassette 2 is the repressor expression cassette; and, Cassette 3 is an expression cassette providing an HRA gene. The repressors tested in Cassette 2 are described in Table 21. The polynucleotides comprising the repressor coding region were synthesized to comprise plant preferred codons. In all cases Cassette 1 contained a 35S cauliflower mosaic virus promoter having three tet operators introduced near the TATA box (Gatz et al. (1992) *Plant J* 2:397-404 (3XOpT 35S)) driving expression of DsRed followed by the 35S cauliflower mosaic virus 3' terminator region. In all cases cassette three contained the S-adenoyslmethionine synthase promoter followed by the HRA version of the acetolactase synthase (ALS) gene followed by the *Glycine max* ALS 3' terminator. The HRA version of the ALS gene confers resistance to sulfonylurea herbicides. EF1A1 is the promoter of a soybean translation elongation factor EF1 alpha described in patent publication US20080313776.

TABLE 21

| Fragment Name | Fragment alias | Cassette 2 | Repressor alias | Repressor SEQ ID | Fragment SEQ ID |
|---|---|---|---|---|---|
| PHP37586A | CHSW004 | EF1A1::EsR1::Nos3' | L7-IC3-A5 | 1240 | 1222 |
| PHP37587A | CHSW005 | EF1A1::EsR2::Nos3' | L7-1F8-A11 | 1241 | 1223 |
| PHP37588A | CHSW006 | EF1A1::EsR2::Nos3 | L7-1G6-B2 | 1242 | 1224 |
| PHP37589A | CHSW007 | EF1A1::EsR4::Nos3' | L7-3E3-D1 | 1243 | 1225 |
| PHP39389A | CHSW010 | EF1A1::EsR5::CaMV35S3' | L12-1-10 | 1232 | 1226 |
| PHP39390A | CHSW011 | EF1A1::EsR6::CaMV35S3' | L13-2-23 | 1233 | 1227 |

DNA fragments were used for soybean transformation according to the protocol described in Example 6A. Plants were regenerated and leaf discs (~0.5 cm) were harvested from young leaves. The leaf discs were incubated in SB103 liquid media containing 0 ppm, 0.5 ppm or 5 ppm ethametsulfuron for 2-5 days. Ethametsulfuron (product number PS-2183) was purchased from Chem Service (West Chester, Pa.) and solubilized in either 10 mM NaOH or 10 mM NH$_4$OH. On each day leaf discs were examined under a dissecting microscope with a DsRed band pass filter. The presence of DsRed was scored visually.

Plants that expressed DsRed at 0 time were scored as leaky. Plants that did not express DsRed after five days were scored as negative. Plants that expressed DsRed after addition of ethametsulfuron were scored as inducible. Results from plants derived from DNAs described in Table 21 are shown in Table 22.

TABLE 22

| Name | Alias | Total Events | % Leaky | % Negative | % Inducible |
|---|---|---|---|---|---|
| PHP37586A | CHSW004 | 12 | 33 | 33 | 33 |
| PHP37587A | CHSW005 | 28 | 7 | 50 | 43 |
| PHP37588A | CHSW006 | 6 | 0 | 0 | 100 |
| PHP37589A | CHSW007 | 9 | 0 | 22 | 78 |
| PHP39389A | CHSW010* | 19 | 5 | 26 | 42 |
| PHP39390A | CHSW011* | 35 | 0 | 17 | 57 |

*In these cases the total does not equal 100% as multiple plants were examined from some events and, in some cases, different plants from the same event behaved differently.

This shows that the repressor protein responds to ethametsulfuron by inducing expression of DsRed. Plants derived from the first four fragments showed visual evidence of DsRed after three days of incubation. Plants derived from the last two fragments showed visual evidence of DsRed after two days of incubation. The presence of DsRed was scored visually, but this was confirmed by Western Blot analysis on a selection of transformants using a rabbit polyclonal antibody (ab41336) from Abcam (Cambridge, Mass.).

Leaf punches were harvested as described above from a selection of transformants and incubated in SB103 media with 0, 5, 50, 250 and 500 ppb ethametsulfuron. At all concentrations of ethametsulfuron, leaves showed visual evidence of DsRed after three days of incubation. At the lowest concentration (5 ppb) the presence of DsRed was limited to a "halo" near the outside edge of the leaf disc.

Plants were allowed to mature as described in Example 6A. Since soybeans are self fertilizing, the T1 seeds derived from these plants would be expected to segregate 1 wild type: 2 hemizyogote: 1 homozygote if only one transgene locus was created during transformation. Sixteen seeds from five different events were planted and allowed to germinate. Leaf punches were collected from young seedlings and incubated in SB103 media with 0 and 5 ppm ethametsulfuron. Leaf discs were scored for DsRed expression and 0 and 3 days and results are shown in Table 23.

TABLE 23

| Name | Event ID | Total # Seeds Germinated | # Leaky Plants | # Negative Plants | # Inducible Plants |
|---|---|---|---|---|---|
| PHP37586A | 6048.3.8.3 | 11 | 0 | 2 | 9 |
| PHP37587A | 6049.2.2.4 | 12 | 0 | 5 | 7 |
| PHP37588A | 6150.3.2.1 | 14 | 0 | 1 | 13 |
| PHP37589A | 6154.4.5.1 | 15 | 0 | 15 | 0 |
| PHP39389A | 6151.4.18.1 | 12 | 3 | 9 | 0 |

Example 7

Testing of Repressor Proteins in Corn

To evaluate SU repressors in plants, RFP reporter constructs were constructed and transformed into maize cells via *Agrobacterium* using the following T-DNA configuration: RB-35S/TripleOp/Pro::RFP-Ubi Pro::EsR-HRA cassette-PAT cassette-LB.

Using standard molecular biology and cloning techniques, T-DNA vectors having the configuration above comprising selected round 3 SU repressors (EsRs) were constructed. The polynucleotides comprising the repressor coding region were synthesized to comprise plant preferred codons. The constructs are summarized below:

| Construct ID | SU repressor alias (EsR) | SU repressor SEQ ID |
|---|---|---|
| PHP37707 | L7-1C3-A5 | 1240 |
| PHP37708 | L7-1F8-A11 | 1241 |
| PHP37709 | L7-1G6-B2 | 1242 |
| PHP37710 | L7-3E3-D1 | 1243 |

The reporter construct T-DNA contained a 35S promoter with two tet operators flanking the TATA box and one downstream adjacent to the transcription start site (as described by Gatz et al. (1992) Plant Cell 2:397-404) driving expression of the Red Fluorescent Protein gene, a ubiquitin driven SU repressor (EsR), an expression cassette containing the maize HRA gene for SU resistance and a moPAT expression cassette for selection.

Immature embryos were transformed using standard methods and media. Briefly, immature embryos were isolated from maize and contacted with a suspension of *Agrobacterium*, to transfer the T-DNA's containing the sulfonylurea expression cassette to at least one cell of at least one of the immature embryos. The immature embryos were immersed in an *Agrobacterium* suspension for the initiation of inoculation and cultured for seven days. The embryos were then transferred to culture medium containing carbinicillin to kill off any remaining *Agrobacterium*. Next, inoculated embryos were cultured on medium containing both carbinicillin and bialaphos (a selective agent) and growing transformed callus was recovered. The callus was then regenerated into plantlets on solid media before transferring to soil to produce mature plants. Approximately 10 single copy events from each of the constructs were sent to the greenhouse.

Figure 10:
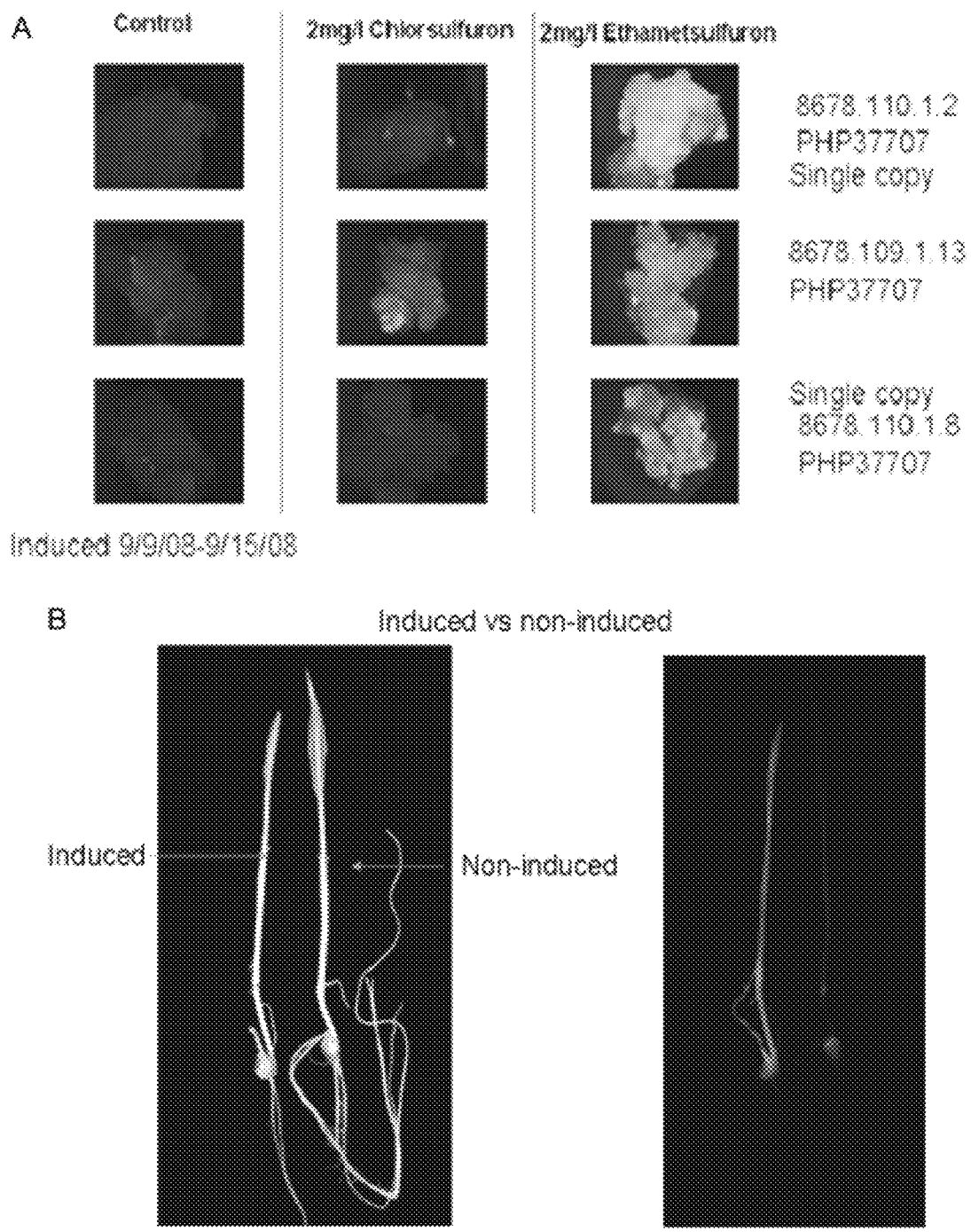
FIG. 10. Sulfonylurea depression of fluorescent reporter in maize callus (A) or plants (B).

To evaluate de-repression, callus was transferred to medium with and without ethametsulfuron and chlorsulfuron and RFP Fluorescence was observed under the microscope (see FIG. 10A). Most events de-repressed and there were no obvious differences between the round three repressors tested. To evaluate de-repression in plants, seeds for single copy plants were germinated in the presence of ethamethsulfron and fluorescence was observed and photographed (see FIG. 10B). As a positive control, a vector containing the same configuration of expression cassettes as PHP37707-10, but with UBI::TetR in place of UBI::EsR, were transformed into maize immature embryos and tested for induction on doxycline. When grown in the presence of 1 mg/l doxycycline, transgenic callus and plants containing the TetR expression cassette induced over a similar 5-6 day period.

The articles "a" and "an" refer to one or more than one of the grammatical object of the article. By way of example, "an element" means one or more of the element. All book, journal, patent publications and grants mentioned in the specification are indicative of the level of those skilled in the art. All publications and patent applications are herein incorporated by reference to the same extent as if each individual publication or patent application was specifically and individually indicated to be incorporated by reference. Although the foregoing invention has been described in some detail by way of illustration and example for purposes of clarity of understanding, certain changes and modifications may be practiced within the scope of the appended claims. These examples and descriptions are illustrative and are not read as limiting the scope of the appended claims.

SEQUENCE LISTING (1247 sequences)

SEQ ID NO: 1 - protein, 207 aa, Escherichia coli
MSRLDKSKVINSALELLNEVGIEGLTTRKLAQKLGVEQPTLYWHVKNKRALLDALAIEMLDRHHTHFCPLEGESWQDFLRNNAKSFRCALLSHRDGAKVHLGTRPTEKQYETLENQLAFLCQQGFSLENALYALSAVGHFTLGCVLEDQEHQVAKEERETPTTDSMPPLLRQAIELFDHQGAEPAFLFGLELIICGLEKQLKCESGS

SEQ ID NO: 2 - protein, 208 aa, Escherichia coli
  derived from wild type Tet repressor - Gly insertion at position 2
MGSRLDKSKVINSALELLNEVGIEGLTTRKLAQKLGVEQPTLYWHVKNKRALLDALAIEMLDRHHTHFCPLEGESWQDFLRNNAKSFRCALLSHRDGAKVHLGTRPTEKQYETLENQLAFLCQQGFSLENALYALSAVGHFTLGCVLEDQEHQVAKEERETPTTDSMPPLLRQAIELFDHQGAEPAFLFGLELIICGLEKQLKCESGS

SEQ ID NO: 3 - protein, 208 aa, Artificial Sequence
  Sulfonylurea responsive repressor L1-02
MGSRLDKSKVINSALELLNEVGIEGLTTRKLAQKLGVEQPTLYWHVKNKRALLDALAIEMLDRHATHFCPLEGESWQDFLRNNAKSFRCALLSHRDGAKVCLGTAVTEKQYETMENILAFLCQQGFSLENALYARRAVIAFTLGCVLWDQEYQVAKEERETPTTDSMPPLLRQARELIDHQGAEPAFLFGLELIICGLEKQLKCESGS

SEQ ID NO: 4 - protein, 208 aa, Artificial Sequence
  Sulfonylurea responsive repressor L1-07
MGSRLDKSKVINSALELLNEVGIEGLTTRKLAQKLGVEQPTLYWHVKNKRALLDALAIEMLDRHNTHFCPLEGESWQDFLRNNAKSWRCALLSHRDGAKVVLGTAITEKQYETHENPLAFLCQQGFSLENALYAIAAVRRFTLGCVLVDQERQVAKEERETPTTDSMPPLLRQASELQDHQGAEPAFLFGLELIICGLEKQLKCERGS

SEQ ID NO: 5 - protein, 208 aa, Artificial Sequence
  Sulfonylurea responsive repressor L1-09
MGSRLDKSKVINSALELLNEVGIEGLTTRKLAQKLGVEQPTLYWHVKNKRALLDALAIEMLDRHATHFCPLEGESWQDFLRNNAKSMRCALLSHRDGAKVCLGTGFTEKQYETAENSLAFLCQQGFSLENALYAMQAVCIFTLGCVLLDQELQVAKEERETPTTDSMPPLLRQALELKDHQGAEPAFLFGLELIICGLEKQLKCESGS

SEQ ID NO: 6 - protein, 208 aa, Artificial Sequence
  Sulfonylurea responsive repressor L1-20
MGSRLDKSKVINSALELLNEVGIEGLTTRKLAQKLGVEQPTLYWHVKNKRALLDALAIEMMDRHQTHFCPLEGESWQDFLRNNAKSMRCALLSHRDGAKVFLGTAWTEKQYETVENLLAFLCQQGFSLENALYALNAVATFTLGCVLWDQEKQVAKEERETPTTDSMPPLLRQAHELGDHQGAEPAFLFGLELIICGLEKQLKSESGS

SEQ ID NO: 7 - protein, 208 aa, Artificial Sequence
  Sulfornylurea responsive repressor L1-22
MGSRLDKSKVINSALELLNEVGIEGLTTRKLAQKLGVEQPTLYWHVKNKRALLDALAIEMMDRHHTHFCPLEGESWQDFLRNTAKSYRCALLSHRDGAKVCLGTAITEKQYETKENNLAFLCQQGFSLENALYARQAVRVFTLGCVLFDQEMQVAKEERETPTTDSMPPLLRQASELLDHQGAEPAFLFGLELIICGLEKQLKSESGS

SEQ ID NO: 8 - protein, 208 aa, Artificial Sequence
  Sulfonylurea responsive repressor L1-24
MGSRLDKSKVINSALELLNEVGIEGLTTRKLAQKLGVEQPTLYWHVKNKRALLDALAIEMLDRHNTHFCPLEGESWQDFLRNSAKSMRCALLSHRDGAKVLLGTAVTEKQYETTENSLAFLCQQGFSLENALYAIRAVRTFTLGCVLVDQERQVAKEERETPTTDSMPPLLRQAKELLDHQGAEPAFLFGLELIICGLEKQLKCESGS

SEQ ID NO: 9 - protein, 208 aa, Artificial Sequence
  Sulfonylurea responsive repressor L1-28
MGSRLDKSKVINSALELLNEVGIEGLTTRKLAQKLGVEQPTLYWHVKNKRALLDALAIEMLDRHATHFCPLEGESWQDFLRNNAKSMRCALLSHRDGAKVWLGTAWTEKQYETPENVLAFLCQQGFSLENALYASRAVVTFTLGCVLTDQEKQVAKEERETPTTDSMPPLLRQAWELLDHQGAEPAFLFGLELIICGLEKQLKCESGS

SEQ ID NO: 10 - protein, 208 aa, Artificial Sequence
  Sulfonylurea responsive repressor L1-29
MGSRLDKSKVINSALELLNEVGIEGLTTRKLAQKLGVEQPTLYWHVKNKRALLDALAIEMMDRHQTHFCPLEGESWQDFLRNTAKSMRCALLSHRDGAKVWLGTRWTEKQYETPENMLAFLCQQGFSLENALYAWSAVCNFTLGCVLSDQERQVAKEERETPTTDSMPPLLRQAWELSDHQGAEPAFLFGLELIICGLEKQLKCESGS

SEQ ID NO: 11 - protein, 208 aa, Artificial Sequence
  Sulfonylurea responsive repressor L1-31
MGSRLDKSKVINSALELLNEVGIEGLTTRKLAQKLGVEQPTLYWHVKNKRALLDALAIEMLDRHATHFCPLEGESWQDFLRNNAKSMRCALLSHRDGAKVMLGTRATEKQYETVENRLAFLCQQGFSLENALYAVRAVHWFTLGCVLIDQEMQVAKEERETPTTDSMPPLLRQAYELYDHQGAEPAFLFGLELIICGLEKQLKCESGS

SEQ ID NO: 12 - protein, 208 aa, Artificial Sequence
  Sulfonylurea responsive repressor L1-38
MGSRLDKSKVINSALELLNEVGIEGLTTRKLAQKLGVEQPTLYWHVKNKRALLDALAIEMADRHHTHFCPLEGESWQDFLRNNAKSMRCALLSHRDGAKVWLGTAWTEKQYETTENMLAFLCQQGFSLENALYAWRAVTMFTLGCVLRDQEWQVAKEERETPTTDSMPPLLRQALELGDHQGAEPAFLFGLELIICGLEKQLKCESGS

SEQ ID NO: 13 - protein, 208 aa, Artificial Sequence
  Sulfonylurea responsive repressor L1-44
MGSRLDKSKVINSALELLNEVGIEGLTTRKLAQKLGVEQPTLYWHVKNKRALLDALAIEMLDRHATHFCPLEGESWQDFLRNNAKSYRCALLSHRDGAKVYLGTAVTEKQYETAENQLAFLCQQGFSLENALYAVKAVAGFTLGCVLWDQESQVAKEERETPTTASMPPLLRQAVELADHQGAEPAFLFGLELIICGLEKQLKCESGS

SEQ ID NO: 14 - protein, 208 aa, Artificial Sequence
  Sulfonylurea responsive repressor L6-1B03
MGSRLDKSKVINSALELLNEVGIEGLTTRKLAQKLGVEQPTLYWHVKNKRALLDALAIEMMDRHATHICPLEGESWQDFLRNNAKSMRCALLSHRDGAKVCLGTRWTEQQYEAAENMLAFLCQQGFSLENALYAVSAVRVFTLGCVLFDQESQVAKEERETPTTASMPPLLRQAWELKDHQGAEPAFLFGLELIICGLEKQLKCESGS

SEQ ID NO: 15 - protein, 208 aa, Artificial Sequence
  Sulfonylurea responsive repressor L6-1C03
  misc_feature (80)..(80): Xaa can be any naturally occurring amino acid
  misc_feature (143)..(143): Xaa can be any naturally occurring amino acid
MGSRLDKSKVINSALELLNEVGIEGLTTRKLAQKLGVEQPTLYWHVKNKRALLDALAIEMMDRHQTHYCPLEGESWQDFXRNNAKSMRCALLSHRDGAKVCLGTRWTEQQYESAENMLAFLCQQGFSLENALYAMSAVRVFTXGCVLFDQESQVAKEERETPTTASMPPLLRQAWELKDHQGAEPAFLFGLELIICGLEKQLKCESGS

SEQ ID NO: 16 - protein, 208 aa, Artificial Sequence
  Sulfonylurea responsive repressor L6-1C06
MGSRLDKSKVINSALELLNEVGIEGLTTRKLAQKLGVEQPTLYWHVKNKRALLDALAIEMMDRHQTHFCPLEGESWQDFLRNNAKSMRCALLSHRDGAKVCLGTRWTEKQYETAENMLAFLCQQGFSLENALYAMSAVRVFTLGCVLFDQELQVAKEERETPTTASMPPLVRQVWELKDHQGAEPAFLFGLELIICGLEKQLKCESGS

SEQ ID NO: 17 - protein, 208 aa, Artificial Sequence
  Sulfonylurea responsive repressor L6-1G06
MGSRLDKSKVINSALELLNEVGIEGLTTRKLAQKLGVEQPTLYWHVKNKRALLDALAIEMMDRHATHYCPLEGESWQDFLRNNAKSMRCALLSHRDGAKVCLGTRWTEKHYETAENMLAFLCQQGFSLENALYAVSAVRVFTLGCVLFDQESQVAKEERETPTTASMPPLLRQAWELKDHQGAEPAFLFGLELIICGLEKQLKCESGS

SEQ ID NO: 18 - protein, 208 aa, Artificial Sequence
  Sulfonylurea responsive repressor L6-1G07
MGSRLDKSKVINSALELLNEVGIEGLTTRKLAQKLGVEQPTLYWHVKNKRALLDALAIEMMDRHATHYCPLEGESWQDFLRNTAKSMRCALLSHRDGAKVCLGTRWTEQQYESAENMLAFLCQQGFSLENALYAVSAVRVFTLGCVLFDQESQVAKEERETPTTASMPPLVRQGWELKDHQGAEPAFLFGLELIICGLEKQLKCESGS

SEQ ID NO: 19 - protein, 208 aa, Artificial Sequence
  Sulfonylurea responsive repressor L6-1G09
MGSRLDKSKVINSALELLNEVGIEGLTTRKLAQKLGVEQPTLYWHVKNKRALLDALAIEMMDRHQTHYCPLEGESWQDFLRNNAKSMRCALLSHRDGAKVCLGTRWTEQLYETAENMLAFLCQQGFSLENALYAVSAVRVFTLGCVLFDQELQVAKEERETPTTASMPPLLRQAWELKDHQGAEPAFLFGLELIICGLEKQLKCESGS

SEQ ID NO: 20 - protein, 208 aa, Artificial Sequence
  Sulfonylurea responsive repressor L6-1G10
MGSRLDKSKVINSALELLNEVGIEGLTTRKLAQKLGVEQPTLYWHVKNKRALLDALAIEMMDRHATHYCPLEGESWQDFLRNNAKSMRCALLSHRDGAKVCLGTRWTEQQYETAENMLAFLCQQGFSLENALYAMSAVRVFTLGCVLFDQESQVAKEERETPTTASMPPLLRQVWELKDHQGAEPAFLFGLELIICGLEKQLKCESGS

SEQ ID NO: 21 - protein, 208 aa, Artificial Sequence
  Sulfonylurea responsive repressor L6-1G11
MGSRLDKSKVINSALELLNEVGIEGLTTRKLAQKLGVEQPTLYWHVKNKRALLDALAIEMMDRHQTHVCPLEGESWQDFLRNNAKSMRCALLSHRDGAKVCLGTRWTEQLYETAENQLAFLCQQGFSLENALYAMSAVRVFTLGCVLFDQELQVAKEERETPTTASMPPLLRQVWELKDHQGAEPAFLFGLELIICGLEKQLKCESGS

SEQ ID NO: 22 - protein, 208 aa, Artificial Sequence
  Sulfonylurea responsive repressor L6-1H12
MGSRLDKSKVINSALELLNEVGIEGLTTRKLAQKLGVEQPTLYWHVKNKRALLDALAIEMMDRHQTHICPLEGESWQDFLRNTAKSMRCALLSHRDGAKVCLGTRWTEQHYETAENQLAFLCQQGFSLENALYAMSAVRVFTLGCVLFDQESQVAKEERETPTTASMPPLVRQAWELKDHQGAEPAFLFGLELIICGLEKQLKCESGS

SEQ ID NO: 23 - protein, 208 aa, Artificial Sequence
  Sulfonylurea responsive repressor L6-2A01
MGSRLDKSKVINSALELLNEVGIEGLTTRKLAQKLGVEQPTLYWHVKNKRALLDALAIEMMDRHQTHVCPLEGESWQDFLRNNAKSMRCALLSHRDGAKVCLGTRWTEKQYEAAENMLAFLCQQGFSLENALYAVSAVRVFTLGCVLFDQESQVAKEERETPTTASMPPLLRQGWELKDHQGAEPAFLFGLELIICGLEKQLKCESGS

SEQ ID NO: 24 - protein, 208 aa, Artificial Sequence
  Sulfonylurea responsive repressor L6-2A02
MGSRLDKSKVINSALELLNEVGIEGLTTRKLAQKLGVEQPTLYWHVKNKRALLDALAIEMMDRHQTHYCPLEGESWQDFLRNTAKSMRCALLSHRDGAKVCLGTRWTEQHYETAENMLAFLCQQGFSLENALYAMSAVRVFTLGCVLFDQELQVAKEERETPTTASMPPLVRQVWELKDHQGAEPAFLFGLELIICGLEKQLKCESGS

SEQ ID NO: 25 - protein, 208 aa, Artificial Sequence
  Sulfonylurea responsive repressor L6-2A04
MGSRLDKSKVINSALELLNEVGIEGLTTRKLAQKLGVEQPTLYWHVKNKRALLDALAIEMMDRHQTHVCPLEGESWQDFLRNNAKSMRCALLSHRDGAKVCLGTRWTEQLYETAENQLAFLCQQGFSLENALYAMSAVRNFTLGCVLFDQESQVAKEERETPTTASMPPLVRQAWELKDHQGAEPAFLFGLELIICGLEKQLKCESGS

SEQ ID NO: 26 - protein, 208 aa, Artificial Sequence
  Sulfonylurea responsive repressor L6-2A06
MGSRLDKSKVINSALELLNEVGIEGLTTRKLAQKLGVEQPTLYWHVKNKRALLDALAIEMMDRHQTHYCPLEGESWQDFLRNNAKSMRCALLSHRDGAKVCLGTRWTEQLYETAENMLAFLCQQGFSLENALYAVSAVRVFTLGCVLFDQESQVAKEERETPTTASMPPLVRQVWELKDHQGAEPAFLFGLELIICGLEKQLKCESGS

SEQ ID NO: 27 - protein, 208 aa, Artificial Sequence
  Sulfonylurea responsive repressor L6-2A12
MGSRLDKSKVINSALELLNEVGIEGLTTRKLAQKLGVEQPTLYWHVKNKRALLDALAIEMMDRHATHVCPLEGESWQDFLRNNAKSMRCALLSHRDGAKVCLGTRWTEQMYETAENQLAFLCQQGFSLENALYAMSAVRVFTLGCVLFDQESQVAKEERETPTTASMPPLVRQAWELKDHQGAEPAFLFGLELIICGLEKQLKCESGS

SEQ ID NO: 28 - protein, 208 aa, Artificial Sequence
  Sulfonylurea responsive repressor L6-2B04
MGSRLDKSKVINSALELLNEVGIEGLTTRKLAQKLGVEQPTLYWHVKNKRALLDALAIEMMDRHQTHVCPLEGESWQDFLRNNAKSMRCALLSHRDGAKVCLGTRWTEKQYESAENMLAFLCQQGFSLENALYAVSAVRVFTLGCVLFDQELQVAKEERETPTTASMPPLLRQGWELNDHQGAEPAFLFGLELIICGLEKQLKCESGS

SEQ ID NO: 29 - protein, 208 aa, Artificial Sequence
  Sulfonylurea responsive repressor L6-2B06
MGSRLDKSKVINSALELLNEVGIEGLTTRKLAQKLGVEQPTLYWHVKNKRALLDALAIEMMDRHQTHYCPLEGESWQDFLRNNAKSMRCALLSHRDGAKVCLGTRWTEQHYEGAENMLAFLCQQGFSLENALYAMSAVRVFTLGCVLFDQELQVAKEERETPTTASMPPLVRQVWELKDHQGAEPAFLFGLELIICGLEKQLKCESGS

SEQ ID NO: 30 - protein, 208 aa, Artificial Sequence
  Sulfonylurea responsive repressor L6-2B08
  misc_feature (152)..(152): Xaa can be any naturally occurring amino acid
MGSRLDKSKVINSALELLNEVGIEGLTTRKLAQKLGVEQPTLYWHVKNKRALLDALAIEMMDRHATHVCPLEGESWQDFLRNNAKSMRCALLSHRDGAKVCLGTRWTEQMYETAENQLAFLCQQGFSLENALYAMSAVRVFTLGCVLFDQEXQVAKEERETPTTASMPPLLRQVWELKDHQGAEPAFLFGLELIICGLEKQLKCESGS

SEQ ID NO: 31 - protein, 208 aa, Artificial Sequence
  Sulfonylurea responsive repressor L6-2B09
MGSRLDKSKVINSALELLNEVGIEGLTTRKLAQKLGVEQPTLYWHVKNKRALLDALAIEMMDRHATHYCPLEGESWQDFLRNTAKSMRCALLSHRDGAKVCLGTRWTEKQYETAENQLAFLCQQGFSLENALYAMSAVRVFTLGCVLFDQELQVAKEERETPTTASMPPLVRQVWELKDHQGAEPAFLFGLELIICGLEKQLKCESGS

SEQ ID NO: 32 - protein, 208 aa, Artificial Sequence
  Sulfonylurea responstive repressor L6-2B10
  misc_feature (65)..(65): Xaa can be any naturally occurring amino acid
MGSRLDKSKVINSALELLNEVGIEGLTTRKLAQKLGVEQPTLYWHVKNKRALLDALAIEMMDRHXTHYCPLEGESWQDFLRNTAKSMRCALLSHRDGAKVCLGTRWTEKQYETAENQLAFLCQQGFSLENALYAMSAVRVFTLGCVLFDQESQVAKEERETPTTASMPPLVRQGWELKDHQGAEPAFLFGLELIICGLEKQLKCESGS

SEQ ID NO: 33 - protein, 208 aa, Artificial Sequence
  Sulfonylurea responsive repressor L6-2B11
MGSRLDKSKVINSALELLNEVGIEGLTTRKLAQKLGVEQPTLYWHVKNKRALLDALAIEMMDRHQTHMCPLEGESWQDFLRNNAKSMRCALLSHRDGAKVCLGTRWTEKHYETAENMLAFLCQQGFSLENALYAVSAVRVFTLGCVLFDQESQVAKEERETPTTASMPPLVRQGWELKDHQGAEPAFLFGLELIICGLEKQLKCESGS

SEQ ID NO: 34 - protein, 208 aa, Artificial Sequence
  Sulfonylurea responsive repressor L6-2C02
MGSRLDKSKVINSALELLNEVGIEGLTTRKLAQKLGVEQPTLYWHVKNKRALLDALAIEMMDRHQTHLCPLEGESWQDFLRNNAKSMRCALLSHRDGAKVCLGTRWTEKQYESAENMLAFLCQQGFSLENALYAMSAVRVFTLGCVLFDQESQVAKEERETPTTASMPPLVRQVWELKDHQGAEPAFLFGLELIICGLEKQLKCESGS

SEQ ID NO: 35 - protein, 208 aa, Artificial Sequence
  Sulfonylurea responsive repressor L6-2C05
MGSRLDKSKVINSALELLNEVGIEGLTTRKLAQKLGVEQPTLYWHVKNKRALLDALAIEMMDRHQTHYCPLEGESWQDFLRNTAKSMRCALLSHRDGAKVCLGTRWTEKHYETAENQLAFLCQQGFSLENALYAVSAVRVFTLGCVLFDQESQVAKEERETPTTASMPPLVRQVWELKDHQGAEPAFLFGLELIICGLEKQLKCESGS

SEQ ID NO: 36 - protein, 208 aa, Artificial Sequence
  Sulfonylurea responsive repressor L6-2C09
MGSRLDKSKVINSALELLNEVGIEGLTTRKLAQKLGVEQPTLYWHVKNKRALLDALAIEMMDRHQTHYCPLEGESWQDFLRNTAKSMRCALLSHRDGAKVCLGTRWTEQLYETAENQLAFLCQQGFSLENALYAMSAVRVFTLGCVLFDQELQVAKEERETPTTASMPPLLRQAWELKDHQGAEPAFLFGLELIICGLEKQLKCESGS

SEQ ID NO: 37 - protein, 208 aa, Artificial Sequence
  Sulfonylurea responsive repressor L6-2C10
  misc_feature (68)..(68): Xaa can be any naturally occurring amino acid
  misc_feature (113)..(113): Xaa can be any naturally occurring amino acid
MGSRLDKSKVINSALELLNEVGIEGLTTRKLAQKLGVEQPTLYWHVKNKRALLDALAIEMMDRHQTHXCPLEGESWQDFLRNTAKSMRCALLSHRDGAKVCLGTRWTEQQYEXAENLLAFLCQQGFSLENALYAMSAVRVFTLGCVLFDQEIQVAKEERETPTTASMPPLLRQVLELKDHQGAEPAFLFGLELIICGLEKQLKCESGS

SEQ ID NO: 38 - protein, 208 aa, Artificial Sequence
  Sulfonylurea responsive repressor L6-2C11
MGSRLDKSKVINSALELLNEVGIEGLTTRKLAQKLGVEQPTLYWHVKNKRALLDALAIEMMDRHQTHYCPLEGESWQDFLRNTAKSMRCALLSHRDGAKVCLGTRWTEKHYETAENMLAFLCQQGFSLENALYAVSAVRVFTLGCVLFDQESQVAKEERETPTTASMPPLLRQVWELKDHQGAEPAFLFGLELIICGLEKQLKCESGS

SEQ ID NO: 39 - protein, 208 aa, Artificial Sequence
  Sulfonylurea responsive repressor L6-2D01
MGSRLDKSKVINSALELLNEVGIEGLTTRKLAQKLGVEQPTLYWHVKNKRALLDALAIEMMDRHQTHVCPLEGESWQDFLRNNAKSMRCALLSHRDGAKVCLGTRWTEQLYETAENMLAFLCQQGFSLENALYAMSAVRVFTLGCVLFDQESQVAKEERETPTTASMPPLVRQGWELKDHQGAEPAFLFGLELIICGLEKQLKCESGS

SEQ ID NO: 40 - protein, 208 aa, Artificial Sequence
  Sulfonylurea responsive repressor L6-2D02
  misc_feature (110)..(110): Xaa can be any naturally occurring amino acid
MGSRLDKSKVINSALELLNEVGIEGLTTRKLAQKLGVEQPTLYWHVKNKRALLDALAIEMMDRHATHLCPLEGESWQDFLRNNAKSMRCALLSHRDGAKVCLGTRWTEKXYESAENQLAFLCQQGFSLENALYAMSAVRVFTLGCVLFDQELQVAKEERETPTTASMPPLLRQAWELKDHQGAEPAFLFGLELIICGLEKQLKCESGS

SEQ ID NO: 41 - protein, 208 aa, Artificial Sequence
  Sulfonylurea responsive repressor L6-2D03
MGSRLDKSKVINSALELLNEVGIEGLTTRKLAQKLGVEQPTLYWHVKNKRALLDALAIEMMDRHQTHYCPLEGESWQDFLRNTAKSMRCALLSHRDGAKVCLGTRWTEQQYETAENMLAFLCQQGFSLENALYAVSAVRNFTLGCVLFDQESQVAKEERETPTTASMPPLVRQAWELKDHQGAEPAFLFGLELIICGLEKQLKCESGS

SEQ ID NO: 42 - protein, 208 aa, Artificial Sequence
  Sulfonylurea responsive repressor L6-2D04
MGSRLDKSKVINSALELLNEVGIEGLTTRKLAQKLGVEQPTLYWHVKNKRALLDALAIEMMDRHQTHFCPLEGESWQDFLRNNAKSMRCALLSHRDGAKVWLGTRWTEQMYETAENMLAFLCQQGFSLENALYAVSAVRNFTLGCVLFDQESQVAKEERETPTTASMPPLLRQGWELKDHQGAEPAFLFGLELIICGLEKQLKCESGS

SEQ ID NO: 43 - protein, 208 aa, Artificial Sequence
  Sulfonylurea responsive repressor L6-2D07
MGSRLDKSKVINSALELLNEVGIEGLTTRKLAQKLGVEQPTLYWHVKNKRALLDALAIEMMDRHQTHFCPLEGESWQDFLRNTAKSMRCALLSHRDGAKVCLGTRWTEQQYETAENMLAFLCQQGFSLENALYAMSAVRVFTLGCVLFDQESQVAKEERETPTTASMPPLVRQAWELKDHQGAEPAFLFGLELIICGLEKQLKCESGS

SEQ ID NO: 44 - protein, 208 aa, Artificial Sequence
  Sulfonylurea responsive repressor L6-2D11
MGSRLDKSKVINSALELLNEVGIEGLTTRKLAQKLGVEQPTLYWHVKNKRALLDALAIEMMDRHQTHYCPLEGESWQDFLRNTAKSMRCALLSHRDGAKVCLGTRWTEQQYESAENQLAFLCQQGFSLENALYAVSAVRVFTLGCVLFDQESQVAKEERETPTTASMPPLLRQAWELKDHQGAEPAFLFGLELIICGLEKQLKCESGS

SEQ ID NO: 45 - protein, 208 aa, Artificial Sequence
  Sulfonylurea responsive repressor L6-2D12
MGSRLDKSKVINSALELLNEVGIEGLTTRKLAQKLGVEQPTLYWHVKNKRALLDALAIEMMDRHQTHMCPLEGESWQDFLRNNAKSMRCALLSHRDGAKVCLGTRWTEKMYEAAENMLAFLCQQGFSLENALYAVSAVRVFTLGCVLFDQELQVAKEERETPTTASMPPLLRQAWELKDHQGAEPAFLFGLELIICGLEKQLKCESGS

SEQ ID NO: 46 - protein, 208 aa, Artificial Sequence
  Sulfonylurea responsive repressor L6-2E02
MGSRLDKSKVINSALELLNEVGIEGLTTRKLAQKLGVEQPTLYWHVKNKRALLDALAIEMMDRHATHYCPLEGESWQDFIRNTAKSMRCALLSHRDGAKVCLGTRWTEKHYETAENMLAFLCQQGFSLENALYAVSAVGNFTLGCVLFDQESQVAKEERETPTTASMPPLLRQVWELKDHQGAEPAFLFGLELIICGLEKQLKCESGS

SEQ ID NO: 47 - protein, 208 aa, Artificial Sequence
  Sulfonylurea responsive repressor L6-2E03
MGSRLDKSKVINSALELLNEVGIEGLTTRKLAQKLGVEQPTLYWHVKNKRALLDALAIEMMDRHATHLCPLEGESWQDFLRNTAKSMRCALLSHRDGAKVCLGTRWTEKQYESAENQLAFLCQQGFSLENALYAMSAVRVFTLGCVLFDQESQVAKEERETPTTASMPPLLRQVWELKDHQGAEPAFLFGLELIICGLEKQLKCESGS

SEQ ID NO: 48 - protein, 208 aa, Artificial Sequence
  Sulfonylurea responsive repressor L6-2E04
MGSRLDKSKVINSALELLNEVGIEGLTTRKLAQKLGVEQPTLYWHVKNKRALLDALAIEMMDRHQTHYCPLEGESWQDFLRNNAKSMRCALLSHRDGAKVCLGTRWTEQMYESAENMLAFLCQQGFSLENALYAVSAVRVFTLGCVLFDQESQVAKEERETPTTASMPPLLRQGWELKDHQGAEPAFLFGLELIICGLEKQLKCESGS

SEQ ID NO: 49 - protein, 208 aa, Artificial Sequence
  Sulfonylurea responsive repressor L6-2E05
MGSRLDKSKVINSALELLNEVGIEGLTTRKLAQKLGVEQPTLYWHVKNKRALLDALAIEMMDRHQTHFCPLEGESWQDFLRNNAKSMRCALLSHRDGAKVCLGTRWTEQMYEGAENMLAFLCQQGFSLENALYAMSAVRVFTLGCVLFDQESQVAKEERETPTTASMPPLLRQGWELKDHQGAEPAFLFGLELIICGLEKQLKCESGS

SEQ ID NO: 50 - protein, 208 aa, Artificial Sequence
  Sulfonylurea responsive repressor L6-2E07
MGSRLDKSKVINSALELLNEVGIEGLTTRKLAQKLGVEQPTLYWHVKNKRALLDALAIEMMDRHQTHYCPLEGESWQDFLRNNAKSMRCALLSHRDGAKVCLGTRWTEQHYEAAENMLAFLCQQGFSLENALYAMSAVRVFTLGCVLFDQESQVAKEERETPTTASMPPLVRQAWELKDHQGAEPAFLFGLELIICGLEKQLKCESGS

SEQ ID NO: 51 - protein, 208 aa, Artificial Sequence
  Sulfonylurea responsive repressor L6-2E08
MGSRLDKSKVINSALELLNEVGIEGLTTRKLAQKLGVEQPTLYWHVKNKRALLDALAIEMMDRHATHYCPLEGESWQDFLRNNAKSMRCALLSHRDGAKVCLGTRWTEQLYETAENQLAFLCQQGFSLENALYAMSAVRNFTLGCVLFDQESQVAKEERETPTTASMPPLVRQAWELKDHQGAEPAFLFGLELIICGLEKQLKCESGS

SEQ ID NO: 52 - protein, 208 aa, Artificial Sequence
  Sulfonylurea responsive repressor L6-2E09
MGSRLDKSKVINSALELLNEVGIEGLTTRKLAQKLGVEQPTLYWHVKNKRALLDALAIEMMDRHATHMCPLEGESWQDFLRNTAKSMRCALLSHRDGAKVCLGTRWTEKQYETAENMLAFLCQQGFSLENALYAVSAVRVFTLGCVLFDQESQVAKEERETPTTASMPPLLRQVWELKDHQGAEPAFLFGLELIICGLEKQLKCESGS

SEQ ID NO: 53 - protein, 208 aa, Artificial Sequence
  Sulfonylurea responsive repressor L6-2E11
MGSRLDKSKVINSALELLNEVGIEGLTTRKLAQKLGVEQPTLYWHVKNKRALLDALAIEMMDRHATHYCPLEGESWQDFLRNTAKSMRCALLSHRDGAKVCLGTRWTEKLYETAENMLAFLCQQGFSLENALYAVSAVRVFTLGCVLFDQELQVAKEERETPTTASMPPLVRQAWELKDHQGAEPAFLFGLELIICGLEKQLKCESGS

SEQ ID NO: 54 - protein, 208 aa, Artificial Sequence
  Sulfonylurea responsive repressor L6-2F08
MGSRLDKSKVINSALELLNEVGIEGLTTRKLAQKLGVEQPTLYWHVKNKRALLDALAIEMMDRHATHFCPLEGESWQDFLRNTAKSMRCALLSHRDGAKVCLGTRWTEQLYETAENMLAFLCQQGFSLENALYAMSAVRVFTLGCVLFDQESQVAKEERETPTTASMPPLVRQGWELKDHQGAEPAFLFGLELIICGLEKQLKCESGS

SEQ ID NO: 55 - protein, 208 aa, Artificial Sequence
  Sulfonylurea responsive repressor L6-2F10
MGSRLDKSKVINSALELLNEVGIEGLTTRKLAQKLGVEQPTLYWHVKNKRALLDALAIEMMDRHQTHLCPLEGESWQDFLRNNAKSMRCALLSHRDGAKVCLGTRWTEKHYEAAENQLAFLCQQGFSLENALYAMSAVRVFTLGCVLFDQESQVAKEERETPTTASMPPLLRQGWELKDHQGAEPAFLFGLELIICGLEKQLKCESGS

SEQ ID NO: 56 - protein, 208 aa, Artificial Sequence
  Sulfonylurea responsive repressor L6-2F11
  misc_feature (65)..(65): Xaa can be any naturally occurring amino acid
  misc_feature (110)..(110): Xaa can be any naturally occurring amino acid
MGSRLDKSKVINSALELLNEVGIEGLTTRKLAQKLGVEQPTLYWHVKNKRALLDALAIEMMDRHXTHYCPLEGESWQDFLRNNAKSMRCALLSHRDGAKVWLGTRWTEQXYETAENQLAFLCQQGFSLENALYAVSAVRVFTLGCVLFDQELQVAKEERETPTTASMPPLLRQGLELKDHQGAEPAFLFGLELIICGLEKQLKCESGS

SEQ ID NO: 57 - protein, 208 aa, Artificial Sequence
  Sulfonylurea responsive repressor L6-2F12
MGSRLDKSKVINSALELLNEVGIEGLTTRKLAQKLGVEQPTLYWHVKNKRALLDALAIEMMDRHATHYCPLEGESWQDFLRNTAKSMRCALLSHRDGAKVCLGTRWTEQQYESAENMLAFLCQQGFSLENALYAMSAVRVFTLGCVLFDQELQVAKEERETPTTASMPPLVRQGWELKDHQGAEPAFLFGLELIICGLEKQLKCESGS

SEQ ID NO: 58 - protein, 208 aa, Artificial Sequence
  Sulfonylurea responsive repressor L6-2G01
MGSRLDKSKVINSALELLNEVGIEGLTTRKLAQKLGVEQPTLYWHVKNKRALLDALAIEMMDRHATHYCPLEGESWQDFLRNTAKSMRCALLSHRDGAKVCLGTRWTEQQYETAENMLAFLCQQGFSLENALYAVSAVRVFTLGCVLFDQELQVAKEERETPTTASMPPLVRQAWELKDHQGAEPAFLFGLELIICGLEKQLKCESGS

SEQ ID NO: 59 - protein, 208 aa, Artificial Sequence
  Sulfonylurea responsive repressor L6-2G02
  misc_feature (68)..(68): Xaa can be any naturally occurring amino acid
  misc_feature (83)..(83): Xaa can be any naturally occurring amino acid
  misc_feature (101)..(101): Xaa can be any naturally occurring amino acid
  misc_feature (171)..(171): Xaa can be any naturally occurring amino acid
MGSRLDKSKVINSALELLNEVGIEGLTTRKLAQKLGVEQPTLYWHVKNKRALLDALAIEMMDRHPTHXCPLEGESWQDFLRNXAKSMRCALLSHRDGAKVXLGTRWTEQLYETAENMLAFLCQQGFSLENALYAMSAVRVFTLGCVLFDQESQVAKEERETPTTASMPPLXRQVWELKDHQGAEPAFLFGLELIICGLEKQLKCESGS

SEQ ID NO: 60 - protein, 208 aa, Artificial Sequence
  Sulfonylurea responsive repressor L6-2G03
  misc_feature (171)..(171): Xaa can be any naturally occurring amino acid
MGSRLDKSKVINSALELLNEVGIEGLTTRKLAQKLGVEQPTLYWHVKNKRALLDALAIEMMDRHATHYCPLEGESWQDFLRNNAKSMRCALLSHRDGAKVCLGTRWTEQLYETAENQLAFLCQQGFSLENALYAVSAVRVFTLGCVLFDQESQVAKEERETPTTASMPPLXRQGWELKDHQGAEPAFLFGLELIICGLEKQLKCESGS

SEQ ID NO: 61 - protein, 208 aa, Artificial Sequence
  Sulfonylurea responsive repressor L6-2G05
MGSRLDKSKVINSALELLNEVGIEGLTTRKLAQKLGVEQPTLYWHVKNKRALLDALAIEMMDRHQTHYCPLEGESWQDFLRNNAKSMRCALLSHRDGAKVCLGTRWTEQQYEAAENQLAFLCQQGFSLENALYAMSAVRVFTLGCVLFDQELQVAKEERETPTTASMPPLVRQAWELKDHQGAEPAFLFGLELIICGLEKQLKCESGS

SEQ ID NO: 62 - protein, 208 aa, Artificial Sequence
  Sulfronylurea responsive repressor L6-2G10
MGSRLDKSKVINSALELLNEVGIEGLTTRKLAQKLGVEQPTLYWHVKNKRALLDALAIEMMDRHQTHYCPLEGESWQDFLRNTAKSMRCALLSHRDGAKVCLGTRWTEQMYESAENMLAFLCQQGFSLENALYAVSAVRVFTLGCVLFDQESQVAKEERETPTTASMPPLLRQGWELKDHQGAEPAFLFGLELIICGLEKQLKCESGS

SEQ ID NO: 63 - protein, 208 aa, Artificial Sequence
  Sulfonylurea responsive repressor L6-2H01
MGSRLDKSKVINSALELLNEVGIEGLTTRKLAQKLGVEQPTLYWHVKNKRALLDALAIEMMDRHQTHYCPLEGESWQDFLRNNAKSMRCALLSHRDGAKVCLGTRWTEQQYESAENQLAFLCQQGFSLENALYAVSAVRVFTLGCVLFDQESQVAKEERETPTTASMPPLVRQAWELKDHQGAEPAFLFGLELIICGLEKQLKCESGS

SEQ ID NO: 64 - protein, 208 aa, Artificial Sequence
  Sulfonylurea responsive repressor L6-2H02
MGSRLDKSKVINSALELLNEVGIEGLTTRKLAQKLGVEQPTLYWHVKNKRALLDALAIEMMDRHQTHYCPLEGESWQDFLRNNAKSMRCALLSHRDGAKVCLGTRWTEKLYETAENMLAFLCQQGFSLENALYAVSAVRVFTLGCVLFDQESQVAKEERETPTTASMPPLLRQVWELKDHQGAEPAFLFGLELIICGLEKQLKCESGS

SEQ ID NO: 65 - protein, 208 aa, Artificial Sequence
  Sulfonylurea responsive repressor L6-2H03
MGSRLDKSKVINSALELLNEVGIEGLTTRKLAQKLGVEQPTLYWHVKNKRALLDALAIEMMDRHATHYCPLEGESWQDFLRNTAKSMRCALLSHRDGAKVCLGTRWTEQMYETAENMLAFLCQQGFSLENALYAMSAVRVFTLGCVLFDQELQVAKEERETPTTASMPPLVRQGWELKDHQGAEPAFLFGLELIICGLEKQLKCESGS

SEQ ID NO: 66 - protein, 208 aa, Artificial Sequence
  Sulfornylurea responsive repressor L6-2H04
MGSRLDKSKVINSALELLNEVGIEGLTTRKLAQKLGVEQPTLYWHVKNKRALLDALAIEMMDRHQTHYCPLEGESWQDFLRNNAKSMRCALLSHRDGAKVCLGTRWTEQMYETAENQLAFLCQQGFSLENALYAMSAVRVFTLGCVLFDQELQVAKEERETPTTASMPPLLRQGWELKDHQGAEPAFLFGLELIICGLEKQLKCESGS

SEQ ID NO: 67 - protein, 208 aa, Artificial Sequence
  Sulfonylurea responsive repressor L6-2H06
MGSRLDKSKVINSALELLNEVGIEGLTTRKLAQKLGVEQPTLYWHVKNKRALLDALAIEMMDRHATHYCPLEGESWQDFLRNTAKSMRCALLSHRDGAKVCLGTRWTEQQYEAAENQLAFLCQQGFSLENALYAVSAVRVFTLGCVLFDQESQVAKEERETPTTASMPPLLRQGWELKDHQGAEPAFLFGLELIICGLEKQLKCESGS

SEQ ID NO: 68 - protein, 208 aa, Artificial Sequence
  Sulfonylurea responsive repressor L6-2H07
MGSRLDKSKVINSALELLNEVGIEGLTTRKLAQKLGVEQPTLYWHVKNKRALLDALAIEMMDRHQTHYCPLEGESWQDFLRNTAKSMRCALLSHRDGAKVWLGTRWTEQQYESAENMLAFLCQQGFSLENALYAVSAVRVFTLGCVLFDQELQVAKEERETPTTASMPPLVRQAWELKDHQGAEPAFLFGLELIICGLEKQLKCESGS

SEQ ID NO: 69 - protein, 208 aa, Artificial Sequence
  Sulfonylurea responsive repressor L6-2H10
MGSRLDKSKVINSALELLNEVGIEGLTTRKLAQKLGVEQPTLYWHVKNKRALLDALAIEMMDRHQTHMCPLEGESWQDFLRNNAKSMRCALLSHRDGAKVCLGTRWTEKLYETAENQLAFLCQQGFSLENALYAVSAVRVFTLGCVLFDQESQVAKEERETPTTASMPPLVRQAWELKDHQGAEPAFLFGLELIICGLEKQLKCESGS

SEQ ID NO: 70 - protein, 208 aa, Artificial Sequence
  Sulfonylurea responsive repressor L6-2H11
MGSRLDKSKVINSALELLNEVGIEGLTTRKLAQKLGVEQPTLYWHVKNKRALLDALAIEMMDRHQTHYCPLEGESWQDFLRNTAKSMRCALLSHRDGAKVCLGTRWTEKQYETAENMLAFLCQQGFSLENALYAMSAVRVFTLGCVLFDQESQVAKEERETPTTASMPPLVRQVWELKDHQGAEPAFLFGLELIICGLEKQLKCESGS

SEQ ID NO: 71 - protein, 208 aa, Artificial Sequence
  Sulfonylurea responsive repressor L6-3A01
MGSRLDKSKVINSALELLNEVGIEGLTTRKLAQKLGVEQPTLYWHVKNKRALLDALAIEMMDRHQTHFCPLEGESWQDFLRNNAKSMRCALLSHRDGAKVCLGTRWTEQQYESAENQLAFLCQQGFSLENALYAVSAVRVFTLGCVLFDQELQVAKEERETPTTASMPPLLRQALELKDHQGAEPAFLFGLELIICGLEKQLKCESGS

SEQ ID NO: 72 - protein, 208 aa, Artificial Sequence
  Sulfonylurea responsive repressor L6-3A02
MGSRLDKSKVINSALELLNEVGIEGLTTRKLAQKLGVEQPTLYWHVKNKRALLDALAIEMMDRHATHYCPLEGESWQDFLRNNAKSMRCALLSHRDGAKVCLGTRWTEKQYESAENMLAFLCQQGFSLENALYAVSAVRNFTLGCVLFDQESQVAKEERETPTTASMPPLLRQGWELKDHQGAEPAFLFGLELIICGLEKQLKCESGS

SEQ ID NO: 73 - protein, 208 aa, Artificial Sequence
  Sulfonylurea responsive repressor L6-3A03
MGSRLDKSKVINSALELLNEVGIEGLTTRKLAQKLGVEQPTLYWHVKNKRALLDALAIEMMDRHATHMCPLEGESWQDFLRNNAKSMRCALLSHRDGAKVCLGTRWTEKHYESAENMLAFLCQQGFSLENALYAVSAVRVFTLGCVLFDQELQVAKEERETPTTASMPPLVRQVWELKDHQGAEPAFLFGLELIICGLEKQLKCESGS

SEQ ID NO: 74 - protein, 208 aa, Artificial Sequence
  Sulfonylurea responsive repressor L6-3A06
  misc_feature (65)..(65): Xaa can be any naturally occurring amino acid
  misc_feature (117)..(117): Xaa can be any naturally occurring amino acid
MGSRLDKSKVINSALELLNEVGIEGLTTRKLAQKLGVEQPTLYWHVKNKRALLDALAIEMMDRHXTHLCPLEGESWQDFLRNTAKSMRCALLSHRDGAKVCLGTRWTEQLYEAAENXLAFLCQQGFSLENALYAMSAVRVFTLGCVLFDQESQVAKEERETPTTASMPPLVRQVWELKDHQGAEPAFLFGLELIICGLEKQLKCESGS

SEQ ID NO: 75 - protein, 208 aa, Artificial Sequence
  Sulfonylurea responsive repressor L6-3A11
MGSRLDKSKVINSALELLNEVGIEGLTTRKLAQKLGVEQPTLYWHVKNKRALLDALAIEMMDRHQTHYCPLEGESWQDFLRNNAKSMRCALLSHRDGAKVCLGTRWTEQHYEGAENMLAFLCQQGFSLENALYAVSAVRVFTLGCVLFDQESQVAKEERETPTTASMPPLLRQVWELKDHQGAEPAFLFGLELIICGLEKQLKCESGS

SEQ ID NO: 76 - protein, 208 aa, Artificial Sequence
  Sulfonylurea responsive repressor L6-3B08
MGSRLDKSKVINSALELLNEVGIEGLTTRKLAQKLGVEQPTLYWHVKNKRALLDALAIEMMDRHATHICPLEGESWQDFLRNNAKSMRCALLSHRDGAKVCLGTRWTEQLYESAENMLAFLCQQGFSLENALYAVSAVRVFTLGCVLFDQESQVAKEERETPTTASMPPLVRQVWELKDHQGAEPAFLFGLELIICGLEKQLKCESGS

SEQ ID NO: 77 - protein, 208 aa, Artificial Sequence
  Sulfonylurea responsive repressor L6-3B09
MGSRLDKSKVINSALELLNEVGIEGLTTRKLAQKLGVEQPTLYWHVKNKRALLDALAIEMMDRHQTHYCPLEGESWQDFLRNNAKSMRCALLSHRDGAKVCLGTRWTEKQYETAENQLAFLCQQGFSLENALYAMSAVRNFTLGCVLFDQESQVAKEERETPTTASMPPLLRQGWELKDHQGAEPAFLFGLELIICGLEKQLKCESGS

SEQ ID NO: 78 - protein, 208 aa, Artificial Sequence
  Sulfonylurea responsive repressor L6-3C02
MGSRLDKSKVINSALELLNEVGIEGLTTRKLAQKLGVEQPTLYWHVKNKRALLDALAIEMMDRHQTHYCPLEGESWQDFLRNNAKSMRCALLSHRDGAKVCLGTRWTEQHYETAENMLAFLCQQGFSLENALYAMSAVRVFTLGCVLFDQESQVAKEERETPTTASMPPLLRQGWELKDHQGAEPAFLFGLELIICGLEKQLKCESGS

SEQ ID NO: 79 - protein, 208 aa, Artificial Sequence
  Sulfonylurea responsive repressor L6-3C04
  misc_feature (110)..(110): Xaa can be any naturally occurring amino acid
  misc_feature (113)..(113): Xaa can be any naturally occurring amino acid
  misc_feature (117)..(117): Xaa can be any naturally occurring amino acid
  misc_feature (135)..(135): Xaa can be any naturally occurring amino acid
  misc_feature (140)..(140): Xaa can be any naturally occurring amino acid
MGSRLDKSKVINSALELLNEVGIEGLTTRKLAQKLGVEQPTLYWHVKNKRALLDALAIEMMDRHPTHLCPLEGESWQDFLRNTAKSMRCALLSHRDGAKVCLGTRWTEQXYEXAENXLAFLCQQGFSLENALYAXSAVRXFTLGCVLFDQEIQVAKEERETPTTASMPPLVRQAWELKDHQGAEPAFLFGLELIICGLEKQLKCESGS

SEQ ID NO: 80 - protein, 208 aa, Artificial Sequence
  Sulfonylurea responsive repressor L6-3C05
MGSRLDKSKVINSALELLNEVGIEGLTTRKLAQKLGVEQPTLYWHVKNKRALLDALAIEMMDRHATHICPLEGESWQDFLRNNAKSMRCALLSHRDGAKVCLGTRWTEQMYETAENQLAFLCQQGFSLENALYAMSAVRVFTLGCVLFDQELQVAKEERETPTTASMPPLLRQVWELKDHQGAEPAFLFGLELIICGLEKQLKCESGS

SEQ ID NO: 81 - protein, 208 aa, Artificial Sequence
  Sulfonylurea responsive repressor L6-3C06
MGSRLDKSKVINSALELLNEVGIEGLTTRKLAQKLGVEQPTLYWHVKNKRALLDALAIEMMDRHQTHICPLEGESWQDFLRNNAKSMRCALLSHRDGAKVCLGTRWTEKHYETAENMLAFLCQQGFSLENALYAMSAVRVFTLGCVLFDQESQVAKEERETPTTASMPPLVRQVWELKDHQGAEPAFLFGLELIICGLEKQLKCESGS

SEQ ID NO: 82 - protein, 208 aa, Artificial Sequence
  Sulfonylurea responsive repressor L6-3D03
MGSRLDKSKVINSALELLNEVGIEGLTTRKLAQKLGVEQPTLYWHVKNKRALLDALAIEMMDRHQTHVCPLEGESWQDFLRNTAKSMRCALLSHRDGAKVCLGTRWTEQLYETAENMLAFLCQQGFSLENALYAVSAVRVFTLGCVLFDQESQVAKEERETPTTARMPPLLRQGWELKDHQGAEPAFLFGLELIICGLEKQLKCESGS

SEQ ID NO: 83 - protein, 208 aa, Artificial sequence
  Sulfonylurea responsive repressor L6-3D05
MGSRLDKSKVINSALELLNEVGIEGLTTRKLAQKLGVEQPTLYWHVKNKRALLDALAIEMMDRHQTHYCPLEGESWQDFLRNTAKSMRCALLSHRDGAKVCLGTRWTEQLYESAENMLAFLCQQGFSLENALYAMSAVRVFTLGCVLFDQELQVAKEERETPTTASMPPLLRQGWELKDHQGAEPAFLFGLELIICGLEKQLKCESGS

SEQ ID NO: 84 - protein, 208 aa, Artificial Sequence
  Sulfonylurea responsive repressor L6-3D09
MGSRLDKSKVINSALELLNEVGIEGLTTRKLAQKLGVEQPTLYWHVKNKRALLDALAIEMMDRHQTHYCPLEGESWQDFLRNTAKSMRCALLSHRDGAKVCLGTRWTEKQYETAENQLAFLCQQGFSLENALYAVSAVRVFTLGCVLFDQESQVAKEERETPTTASMPPLVRQVWELKDHQGAEPAFLFGLELIICGLEKQLKCESGS

SEQ ID NO: 85 - protein, 208 aa, Artificial Sequence
  Sulfonylurea responsive repressor L6-3E08
MGSRLDKSKVINSALELLNEVGIEGLTTRKLAQKLGVEQPTLYWHVKNKRALLDALAIEMMDRHATHYCPLEGESWQDFLRNNAKSMRCALLSHRDGAKVCLGTRWTEQHYETAENQLAFLCQQGFSLENALYAMSAVRVFTLGCVLFDQESQVAKEERETPTTASMPPLVRQGWELKDHQGAEPAFLFGLELIICGLEKQLKCESGS

SEQ ID NO: 86 - protein, 208 aa, Artificial Sequence
  Sulfonylurea responsive repressor L6-3E09
MGSRLDKSKVINSALELLNEVGIEGLTTRKLAQKLGVEQPTLYWHVKNKRALLDALAIEMMDRHQTHYCPLEGESWQDFLRNNAKSMRCALLSHRDGAKVCLGTRWTEKHYETAENQLAFLCQQGFSLENALYAMSAVRVFTLGCVLFDQESQVAKEERETPTTASMPPLLRQAWELKDHQGAEPAFLFGLELIICGLEKQLKCESGS

SEQ ID NO: 87 - protein, 208 aa, Artificial Sequence
  Sulfonylurea responsive repressor L6-3E10
MGSRLDKSKVINSALELLNEVGIEGLTTRKLAQKLGVEQPTLYWHVKNKRALLDALAIEMMDRHQTHYCPLEGESWQDFLRNNAKSMRCALLSHRDGAKVCLGTRWTEQHYEAAENMLAFLCQQGFSLENALYAVSAVRVFTLGCVLFDQESQVAKEERETPTTASMPPLLRQVWELKDHQGAEPAFLFGLELIICGLEKQLKCESGS

SEQ ID NO: 88 - protein, 208 aa, Artificial Sequence
  Sulfonylurea responsive repressor L6-3F02
MGSRLDKSKVINSALELLNEVGIEGLTTRKLAQKLGVEQPTLYWHVKNKRALLDALAIEMMDRHQTHYCPLEGESWQDFLRNNAKSMRCALLSHRDGAKVCLGTRWTEQMYEAAENQLAFLCQQGFSLENALYAVSAVRVFTLGCVLFDQELQVAKEERETPTTASMPPLVRQVWELKDHQGAEPAFLFGLELIICGLEKQLKCESGS

SEQ ID NO: 89 - protein, 208 aa, Artificial Sequence
  Sulfonylurea responsive repressor L6-3F09
MGSRLDKSKVINSALELLNEVGIEGLTTRKLAQKLGVEQPTLYWHVKNKRALLDALAIEMMDRHQTHYCPLEGESWQDFLRNNAKSMRCALLSHRDGAKVCLGTRWTEKLYEAAENMLAFLCQQGFSLENALYAVSAVRVFTLGCVLFDQESQVAKEERETPTTASMPPLVRQVWELKDHQGAEPAFLFGLELIICGLEKQLKCESGS

SEQ ID NO: 90 - protein, 208 aa, Artificial Sequence
  Sulfonylurea responsive repressor L6-3F12
  misc_feature (140)..(140): Xaa can be any naturally occurring amino acid
MGSRLDKSKVINSALELLNEVGIEGLTTRKLAQKLGVEQPTLYWHVKNKRALLDALAIEMMDRHQTHYCPLEGESWQDFLRNTAKSMRCALLSHRDGAKVCLGTRWTEQMYEAAENMLAFLCQQGFSLENALYAMSAVRXFTLGCVLFDQESQVAKEERETPTTASMPPLVRQAWELKDHQGAEPAFLFGLELIICGLEKQLKCESGS

SEQ ID NO: 91 - protein, 208 aa, Artificial Sequence
  Sulfonylurea responsive repressor L6-3G03
  misc_feature (113)..(113): Xaa can be any naturally occurring amino acid
  misc_feature (140)..(140): Xaa can be any naturally occurring amino acid
MGSRLDKSKVINSALELLNEVGIEGLTTRKLAQKLGVEQPTLYWHVKNKRALLDALAIEMMDRHATHYCPLEGESWQDFLRNNAKSMRCALLSHRDGAKVCLGTRWTEQLYEXAENQLAFLCQQGFSLENALYAMSAVRXFTLGCVLFDQESQVAKEERETPTTASMPPLVRQGWELKDHQGAEPAFLFGLELIICGLEKQLKCESGS

SEQ ID NO: 92 - protein, 208 aa, Artificial Sequence
  Sulfonylurea responsive repressor L6-3G05
MGSRLDKSKVINSALELLNEVGIEGLTTRKLAQKLGVEQPTLYWHVKNKRALLDALAIEMMDRHQTHYCPLEGESWQDFLRNTAKSMRCALLSHRDGAKVCLGTRWTEKQYESAENQLAFLCQQGFSLENALYAMSAVRVFTLGCVLFDQESQVAKEERETPTTASMPPLVRQGWELKDHQGAEPAFLFGLELIICGLEKQLKCESGS

SEQ ID NO: 93 - protein, 208 aa, Artificial Sequence
  Sulfonylurea responsive repressor L6-3G09
MGSRLDKSKVINSALELLNEVGIEGLTTRKLAQKLGVEQPTLYWHVKNKRALLDALAIEMMDRHQTHYCPLEGESWQDFLRNNAKSMRCALLSHRDGAKVCLGTRWTEQHYEAAENQLAFLCQQGFSLENALYAVSAVRVFTLGCVLFDQESQVAKEERETPTTASMPPLVRQVWELKDHQGAEPAFLFGLELIICGLEKQLKCESGS

SEQ ID NO: 94 - protein, 208 aa, Artificial Sequence
  Sulfonylurea responsive repressor L6-3H02
MGSRLDKSKVINSALELLNEVGIEGLTTRKLAQKLGVEQPTLYWHVKNKRALLDALAIEMMDRHATHYCPLEGESWQDFLRNTAKSMRCALLSHRDGAKVCLGTRWTEQHYESAENMLAFLCQQGFSLENALYAVSAVRVFTLGCVLFDQESQVAKEERETPTTASMPPLVRQAWELKVHQGAEPAFLFGLELIICGLEKQLKCESGS

SEQ ID NO: 95 - protein, 208 aa, Artificial Sequence
  Sulfonylurea responsive repressor L6-3H05
MGSRLDKSKVINSALELLNEVGIEGLTTRKLAQKLGVEQPTLYWHVKNKRALLDALAIEMMDRHATHYCPLEGESWQDFLRNNAKSMRCALLSHRDGAKVCLGTRWTEQHYESAENQLAFLCQQGFSLENALYAVSAVRVFTLGCVLFDQELQVAKEERETPTTASMPPLLRQVWELKDHQGAEPAFLFGLELIICGLEKQLKCESGS

SEQ ID NO: 96 - protein, 208 aa, Artificial Sequence
  Sulfonylurea responsive repressor L6-3H08
MGSRLDKSKVINSALELLNEVGIEGLTTRKLAQKLGVEQPTLYWHVKNKRALLDALAIEMMDRHATHYCPLEGESWQDFLRNTAKSMRCALLSHRDGAKVCLGTRWTEKQYEAAENQLAFLCQQGFSLENALYAVSAVGNFTLGCVLFDQELQVAKEERETPTTASMPPLVRQALELKDHQGAEPAFLFGLELIICGLEKQLKCESGS

SEQ ID NO: 97 - protein, 208 aa, Artificial Sequence
  Sulfonylurea responsive repressor L6-4A01
MGSRLDKSKVINSALELLNEVGIEGLTTRKLAQKLGVEQPTLYWHVKNKRALLDALAIEMMDRHATHYCPLEGESWQDFLRNTAKSMRCALLSHRDGAKVCLGTRWTEQQYETAENQLAFLCQQGFSLENALYAMSAVRNFTLGCVLFDQESQVAKEERETPTTASMPPLLRQAWELKDHQGAEPAFLFGLELIICGLEKQLKCESGS

SEQ ID NO: 98 - protein, 208 aa, Artificial Sequence
  Sulfonylurea responsive repressor L6-4A03
  misc_feature (67)..(67): Xaa can be any naturally occurring amino acid
  misc_feature (105)..(105): Xaa can be any naturally occurring amino acid
  misc_feature (123)..(123): Xaa can be any naturally occurring amino acid
  misc_feature (138)..(138): Xaa can be any naturally occurring amino acid
  misc_feature (146)..(146): Xaa can be any naturally occurring amino acid
  misc_feature (153)..(153): Xaa can be any naturally occurring amino acid
  misc_feature (181)..(181): Xaa can be any naturally occurring amino acid
MGSRLDKSKVINSALELLNEVGIEGLTTRKLAQKLGVEQPTLYWHVKNKRALLDALAIEMMDRHATXYCPLEGESWQDFLRNNAKSMRCALLSHRDGAKVCLGTXWTEKHYETAENQLAFLCXQGFSLENALYAMSAXRVFTLGCXLFDQELXVAKEERETPTTASMPPLLRQGWELKDHXGAEPAFLFGLELIICGLEKQLKCESGS

SEQ ID NO: 99 - protein, 208 aa, Artificial Sequence
  Sulfonylurea responsive repressor L6-4A04
  misc_feature (105)..(105): Xaa can be any naturally occurring amino acid
MGSRLDKSKVINSALELLNEVGIEGLTTRKLAQKLGVEQPTLYWHVKNKRALLDALAIEMMDRHQTHLCPLEGESWQDFLRNTAKSMRCALLSHRDGAKVCLGTXWTEKMYESAENMLAFLCQQGFSLENALYAVSAVRVFTLGCVLFDQELQVAKEERETPTTASMPPLLRQVWELKDHQGAEPAFLFGLELIICGLEKQLKCESGS

SEQ ID NO: 100 - protein, 208 aa, Artificial Sequence
  Sulfonylurea responsive repressor L6-4A09
  misc_feature (164)..(165): Xaa can be any naturally occurring amino acid
  misc_feature (168)..(168): Xaa can be any naturally occurring amino acid
MGSRLDKSKVINSALELLNEVGIEGLTTRKLAQKLGVEQPTLYWHVKNKRALLDALAIEMMDRHQTHMCPLEGESWQDFLRNNAKSMRCALLSHRDGAKVCLGTRWTEKMYESAENMLAFLCQQGFSLENALYAMSAVRVFTLGCVLFDQESQVAKEERETPTXXSMXPLVRQAWELKDHQGAEPAFLFGLELIICGLEKQLKCESGS

SEQ ID NO: 101 - protein, 208 aa, Artificial Sequence
  Sulfonylurea responsive repressor L6-4A10
MGSRLDKSKVINSALELLNEVGIEGLTTRKLAQKLGVEQPTLYWHVKNKRALLDALAIEMMDRHATHICPLEGESWQDFLRNTAKSMRCALLSHRDGAKVCLGTRWTEQHYESAENQLAFLCQQGFSLENALYAVSAVRVFTLGCVLFDQESQVAKEERETPTTASMPPLLRQVWELKDHQGAEPAFLFGLELIICGLEKQLKCESGS

SEQ ID NO: 102 - protein, 208 aa, Artificial sequence
  Sulfonylurea responsive repressor L6-4A11
  misc_feature (101)..(101): Xaa can be any naturally occurring amino acid
  misc_feature (110)..(110): Xaa can be any naturally occurring amino acid
  misc_feature (113)..(113): Xaa can be any naturally occurring amino acid
  misc_feature (135)..(135): Xaa can be any naturally occurring amino acid
  misc_feature (171)..(171): Xaa can be any naturally occurring amino acid
  misc_feature (174)..(174): Xaa can be any naturally occurring amino acid
MGSRLDKSKVINSALELLNEVGIEGLTTRKLAQKLGVEQPTLYWHVKNKRALLDALAIEMMDRHQTHYCPLEGESWQDFLRNTAKSMRCALLSHRDGAKVXLGTRWTEKXYEXAENQLAFLCQQGFSLENALYAXSAVRVFTLGCVLFDQESQVAKEERETPTTASMPPLXRQXWELKDHQGAEPAFLFGLELIICGLEKQLKCESGS

SEQ ID NO: 103 - protein, 208 aa, Artificial Sequence
  Sulfonylurea responsive repressor L6-4B05
  misc_feature (65)..(65): Xaa can be any naturally occurring amino acid
  misc_feature (68)..(68): Xaa can be any naturally occurring amino acid
  misc_feature (140)..(140): Xaa can be any naturally occurring amino acid
  misc_feature (167)..(167): Xaa can be any naturally occurring amino acid
  misc_feature (174)..(174): Xaa can be any naturally occurring amino acid
MGSRLDKSKVINSALELLNEVGIEGLTTRKLAQKLGVEQPTLYWHVKNKRALLDALAIEMMDRHXTHXCPLEGESWQDFLRNTAKSMRCALLSHRDGAKVCLGTRWTEQHYEAAENLLAFLCQQGFSLENALYAMSAVRXFTLGCVLFDQELQVAKEERETPTTASXPPLVRQXWELKDHQGAEPAFLFGLELIICGLEKQLKCESGS

SEQ ID NO: 104 - protein, 208 aa, Artificial Sequence
  Sulfonylurea responsive repressor L6-4B06
MGSRLDKSKVINSALELLNEVGIEGLTTRKLAQKLGVEQPTLYWHVKNKRALLDALAIEMMDRHATHVCPLEGESWQDFLRNNAKSMRCALLSHRDGAKVCLGTRWTEQQYETAENMLAFLCQQGFSLENALYAVSAVRNFTLGCVLFDQESQVAKEERETPTTASMPPLLRQGWELKDHQGAEPAFLFGLELIICGLEKQLKCESGS

SEQ ID NO: 105 - protein, 208 aa, Artificial Sequence
  Sulfonylurea responsive repressor L6-4B07
MGSRLDKSKVINSALELLNEVGIEGLTTRKLAQKLGVEQPTLYWHVKNKRALLDALAIEMMDRHATHYCPLEGESWQDFLRNNAKSMRCALLSHRDGAKVCLGTRWTEQHYETAENMLAFLCQQGFSLENALYAVSAVRNFTLGCVLFDQELQVAKEERETPTTASMPPLVRQAWELKDHQGAEPAFLFGLELIICGLEKQLKCESGS

SEQ ID NO: 106 - protein, 208 aa, Artificial Sequence
  Sulfonylurea responsive repressor L6-4B08
MGSRLDKSKVINSALELLNEVGIEGLTTRKLAQKLGVEQPTLYWHVKNKRALLDALAIEMMDRHQTHFCPLEGESWQDFLRNNAKSMRCALLSHRDGAKVCLGTRWTEQMYETAENMLAFLCQQGFSLENALYAMSAVRVFTLGCVLFDQESQVAKEERETPTTASMPPLVRQGWELKDHQGAEPAFLFGLELIICGLEKQLKCESGS

SEQ ID NO: 107 - protein, 208 aa, Artificial Sequence
  Sulfonylurea responsive repressor L6-4B12
  misc_feature (156)..(156): Xaa can be any naturally occurring amino acid
  misc_feature (163)..(163): Xaa can be any naturally occurring amino acid
  misc_feature (167)..(167): Xaa can be any naturally occurring amino acid
MGSRLDKSKVINSALELLNEVGIEGLTTRKLAQKLGVEQPTLYWHVKNKRALLDALAIEMMDRHATDYCPLEGESWQDFLRNNAKSMRCALLSHRDGAKVCLGTRWTEKQYETAENMLAFLCQQGFSLENALYAVSAVRVFTLGCVLFDQESQVAXEERETPXTASXPPLVRQVWELKDHQGAEPAFLFGLELIICGLEKQLKCESGS

SEQ ID NO: 108 - protein, 208 aa, Artificial Sequence
  Sulfonylurea responsive repressor L6-4C01
MGSRLDKSKVINSALELLNEVGIEGLTTRKLAQKLGVEQPTLYWHVKNKRALLDALAIEMMDRHQTHYCPLEGESWQDFLRNNAKSMRCALLSHRDGAKVCLGTRWTEQLYETAENQLAFLCQQGFSLENALYAMSAVRVFTLGCVLFDQESQVAKEERETPTTASMPPLVRQAWELKDHQGAEPAFLFGLELIICGLEKQLKCESGS

SEQ ID NO: 109 - protein, 208 aa, Artificial Sequence
  Sulfonylurea responsive repressor L6-4C03
  misc_feature (134)..(134): Xaa can be any naturally occurring amino acid
MGSRLDKSKVINSALELLNEVGIEGLTTRKLAQKLGVEQPTLYWHVKNKRALLDALAIEMMDRHQTHVCPLEGESWQDFLRNNAKSMRCALLSHRDGAKVCLGTRWTEQHYEAAENMLAFLCQQGFSLENALYXMSAVRVFTLGCVLFDQELQVAKEERETPTTASMPPLVRQAWELKDHQGAEPAFLFGLELIICGLEKQLKCESGS

SEQ ID NO: 110 - protein, 208 aa, Artificial Sequence
  Sulfonylurea responsive repressor L6-4C04
MGSRLDKSKVINSALELLNEVGIEGLTTRKLAQKLGVEQPTLYWHVKNKRALLDALAIEMMDRHQTHFCPLEGESWQDFLRNNAKSMRCALLSHRDGAKVCLGTRWTEQQYESAENQLAFLCQQGFSLENALYAMSAVRVFTLGCVLFDQESQVAKEERETPTTASMPPLLRQGLELKDHQGAEPAFLFGLELIICGLEKQLKCESGS

SEQ ID NO: 111 - protein, 208 aa, Artificial Sequence
  Sulfonylurea responsive repressor L6-4C07
MGSRLDKSKVINSALELLNEVGIEGLTTRKLAQKLGVEQPTLYWHVKNKRALLDALAIEMMDRHQTHLCPLEGESWQDFLRNNAKSMRCALLSHRDGAKVCLGTRWTEQLYETAENMLAFLCQQGFSLENALYAMSAVRVFTLGCVLFDQESQVAKEERETPTTASMPPLLRQGWELKDHQGAEPAFLFGLELIICGLEKQLKCESGS

SEQ ID NO: 112 - protein, 208 aa, Artificial Sequence
  Sulfonylurea responsive repressor L6-4C08
MGSRLDKSKVINSALELLNEVGIEGLTTRKLAQKLGVEQPTLYWHVKNKRALLDALAIEMMDRHQTHYCPLEGESWQDFLRNTAKSMRCALLSHRDGAKVCLGTRWTEKLYETAENMLAFLCQQGFSLENALYAMSAVRVFTLGCVLFDQESQVAKEERETPTTASMPPLLRQAWELKDHQGAEPAFLFGLELIICGLEKQLKCESGS

SEQ ID NO: 113 - protein, 208 aa, Artificial Sequence
  Sulfonylurea responsive repressor L6-4C09
MGSRLDKSKVINSALELLNEVGIEGLTTRKLAQKLGVEQPTLYWHVKNKRALLDALAIEMMDRHQTHYCPLEGESWQDFLRNNAKSMRCALLSHRDGAKVCLGTRWTEKQYETAENMLAFLCQQGFSLENALYAMSAVRVFTLGCVLFDQELQVAKEERETPTTASMPPLLRQVWELKDHQGAEPAFLFGLELIICGLEKQLKCESGS

SEQ ID NO: 114 - protein, 208 aa, Artificial Sequence
  Sulfonylurea reponsive repressor L6-4C10
MGSRLDKSKVINSALELLNEVGIEGLTTRKLAQKLGVEQPTLYWHVKNKRALLDALAIEMMDRHQTHYCPLEGESWQDFLRNTAKSMRCALLSHRDGAKVCLGTRWTEQMYESAENQLAFLCQQGFSLENALYAVSAVRVFTLGCVLFDQELQVAKEERETPTTASMPPLLRQAWELKDHQGAEPAFLFGLELIICGLEKQLKCESGS

SEQ ID NO: 115 - protein, 208 aa, Artificial Sequence
  Sulfonylurea responsive repressor L6-4C11
MGSRLDKSKVINSALELLNEVGIEGLTTRKLAQKLGVEQPTLYWHVKNKRALLDALAIEMMDRHQTHYCPLEGESWQDFLRNTAKSMRCALLSHRDGAKVCLGTRWTEKQYETAENMLAFLCQQGFSLENALYAMSAVRVFTLGCVLFDQESQVAKEERETPTTASMPPLLRQGWELKDHQGAEPAFLFGLELIICGLEKQLKCESGS

SEQ ID NO: 116 - protein, 208 aa, Artificial Sequence; identical to SEQ ID NO: 88
  Sulfonylurea responsive repressor L6-4D09

SEQ ID NO: 117 - protein, 208 aa, Artificial Sequence
  Sulfonylurea responsive repressor L6-4D10
MGSRLDKSKVINSALELLNEVGIEGLTTRKLAQKLGVEQPTLYWHVKNKRALLDALAIEMMDRHQTHYCPLEGESWQDFLRNNAKSMRCALLSHRDGAKVCLGTRWTEKQYESAENMLAFLCQQGFSLENALYAVSAVRVFTLGCVLFDQESQVAKEERETPTTASMPPLLRQAWELKDHQGAEPAFLFGLELIICGLEKQLKCESGS

SEQ ID NO: 118 - protein, 208 aa, Artificial Sequence
  Sulfonylurea responsive repressor L6-4E01
MGSRLDKSKVINSALELLNEVGIEGLTTRKLAQKLGVEQPTLYWHVKNKRALLDALAIEMMDRHQTHLCPLEGESWQDFLRNNAKSMRCALLSHRDGAKVCLGTRWTEQLYESAENQLAFLCQQGFSLENALYAVSAVRVFTLGCVLFDQESQVAKEERETPTTASMPPLLRQAWELKDHQGAEPAFLFGLELIICGLEKQLKCESGS

SEQ ID NO: 119 - protein, 208 aa, Artificial Sequence
  Sulfonylurea responsive repressor L6-4E02
MGSRLDKSKVINSALELLNEVGIEGLTTRKLAQKLGVEQPTLYWHVKNKRALLDALAIEMMDRHATHLCPLEGESWQDFLRNNAKSMRCALLSHRDGAKVCLGTRWTEKQYETAENMLAFLCQQGFSLENALYAVSAVRVFTLGCVLFDQESQVAKEERETPTTASMPPLLRQVWELKDHQGAEPAFLFGLELIICGLEKQLKCESGS

SEQ ID NO: 120 - protein, 208 aa, Artificial Sequence
  Sulfonylurea responsive repressor L6-4E03
  misc_feature (165)..(165): Xaa can be any naturally occurring amino acid
  misc_feature (167)..(167): Xaa can be any naturally occurring amino acid
MGSRLDKSKVINSALELLNEVGIEGLTTRKLAQKLGVEQPTLYWHVKNKRALLDALAIEMMDRHATHFCPLEGESWQDFLRNNAKSMRCALLSHRDGAKVCVGTRWTEQMYEAAENQLAFLCQQGFSLENALYAVSAVRVFTLGCVLFDQELQVAKEERETPTTXSXPPLVRQAWELKDHQGAEPAFLFGLELIICGLEKQLKCESGS

SEQ ID NO: 121 - protein, 208 aa, Artificial Sequence
  Sulfonylurea responsive repressor L6-4E05
MGSRLDKSKVINSALELLNEVGIEGLTTRKLAQKLGVEQPTLYWHVKNKRALLDALAIEMMDRHQTHICPLEGESWQDFLRNNAKSMRCALLSHRDGAKVCVGTRWTEKHYESAENMLAFLCQQGFSLENALYAVSAVRVFTLGCVLFDQESQVAKEERETPTTASMPPLLRQAWELKDHQGAEPAFLFGLELIICGLEKQLKCESGS

SEQ ID NO: 122 - protein, 208 aa, Artificial Sequence
  Sulfonylurea responsive repressor L6-4E08
  misc_feature (101)..(101): Xaa can be any naturally occurring amino acid
  misc_feature (117)..(117): Xaa can be any naturally occurring amino acid
  misc_feature (140)..(140): Xaa can be any naturally occurring amino acid
  misc_feature (152)..(152): Xaa can be any naturally occurring amino acid
  misc_feature (175)..(175): Xaa can be any naturally occurring amino acid
MGSRLDKSKVINSALELLNEVGIEGLTTRKLAQKLGVEQPTLYWHVKNKRALLDALAIEMMDRHATHFCPLEGESWQDFLRNNAKSMRCALLSHRDGAKVXLGTRWTEQLYETAENXLAFLCQQGFSLENALYAMSAVRXFTLGCVLFDQEXQVAKEERETPTTASMPPLLRQVXELKDHQGAEPAFLFGLELIICGLEKQLKCESGS

SEQ ID NO: 123 - protein, 208 aa, Artificial Sequence
  Sulfonylurea responsive repressor L6-4E09
MGSRLDKSKVINSALELLNEVGIEGLTTRKLAQKLGVEQPTLYWHVKNKRALLDALAIEMMDRHATHVCPLEGESWQDFLRNTAKSMRCALLSHRDGAKVCLGTRWTEQHYETAENMLAFLCQQGFSLENALYAMSAVRVFTLGCVLFDQESQVAKEERETPTTASMPPLLRQVWELKDHQGAEPAFLFGLELIICGLEKQLKCESGS

SEQ ID NO: 124 - protein, 208 aa, Artificial Sequence
  Sulfonylurea responsive repressor L6-4E11
  misc_feature (68)..(68): Xaa can be any naturally occurring amino acid
  misc_feature (140)..(140): Xaa can be any naturally occurring amino acid
  misc_feature (171)..(171): Xaa can be any naturally occurring amino acid
MGSRLDKSKVINSALELLNEVGIEGLTTRKLAQKLGVEQPTLYWHVKNKRALLDALAIEMMDRHPTHXCPLEGESWQDFLRNTAKSMRCALLSHRDGAKVCLGTRWTEQLYETAENMLAFLCQQGFSLENALYAMSAVRXFTLGCVLFDQEIQVAKEERETPTTASMPPLXRQAWELKDHQGAEPAFLFGLELIICGLEKQLKCESGS

SEQ ID NO: 125 - protein, 208 aa, Artificial Sequence
  Sulfonylurea responsive repressor L6-4E12
  misc_feature (135)..(135): Xaa can be any naturally occurring amino acid
  misc_feature (152)..(152): Xaa can be any naturally occurring amino acid
  misc_feature (171)..(171): Xaa can be any naturally occurring amino acid
  misc_feature (174)..(174): Xaa can be any naturally occurring amino acid
MGSRLDKSKVINSALELLNEVGIEGLTTRKLAQKLGVEQPTLYWHVKNKRALLDALAIEMMDRHATHYCPLEGESWQDFLRNTAKSMRCALLSHRDGAKVCLGTRWTEKLYETAENMLAFLCQQGFSLENALYAXSAVRVFTLGCVLFDQEXQVAKEERETPTTASMPPLXRQXWELKDHQGAEPAFLFGLELIICGLEKQLKCESGS

SEQ ID NO: 126 - protein, 208 aa, Artificial Sequence
  Sulfonylurea responsive repressor L6-4F01
  misc_feature (151)..(151): Xaa can be any naturally occurring amino acid
  misc_feature (164)..(164): Xaa can be any naturally occurring amino acid
  misc_feature (168)..(168): Xaa can be any naturally occurring amino acid
MGSRLDKSKVINSALELLNEVGIEGLTTRKLAQKLGVEQPTLYWHVKNKRALLDALAIEMMDRHATHLCPLEGESWQDFLRNTAKSMRCALLSHRDGAKVCLGTRWTEQLYETAENMLAFLCQQGFSLENALYAVSAVRVFTLGCVLFDQXLQVAKEERETPTXASMXPLVRQGWELKDHQGAEPAFLFGLELIICGLEKQLKCESGS

SEQ ID NO: 127 - protein, 208 aa, Artificial Sequence
  Sulfonylurea responsive repressor L6-4F10
  misc_feature (140)..(140): Xaa can be any naturally occurring amino acid
  misc_feature (152)..(152): Xaa can be any naturally occurring amino acid
MGSRLDKSKVINSALELLNEVGIEGLTTRKLAQKLGVEQPTLYWHVKNKRALLDALAIEMMDRHQTHYCPLEGESWQDFLRNNAKSMRCALLSHRDGAKVWLGTRWTEQLYEAAENLLAFLCQQGFSLENALYAVSAVRXFTLGCVLFDQEXQVAKEERETPTTASMPPLLRQAWELKDHQGAEPAFLFGLELIICGLEKQLKCESGS

SEQ ID NO: 128 - protein, 208 aa, Artificial Sequence
  Sulfonylurea responsive repressor L6-4F12
  misc_feature (167)..(167): Xaa can be any naturally occurring amino acid
MGSRLDKSKVINSALELLNEVGIEGLTTRKLAQKLGVEQPTLYWHVKNKRALLDALAIEMMDRHQTHYCPLEGESWQDFLRNNAKSMRCALLSNRDGAKVCLGTRWTEKLYEAAENQLAFLCQQGFSLENALYAVSAVRVFTLGCVLFDQELQVAKEERETPTTASXPPLVRQAWELKDHQGAEPAFLFGLELIICGLEKQLKCESGS

SEQ ID NO: 129 - protein, 208 aa, Artificial Sequence
  Sulfonylurea responsive repressor L6-4G02
MGSRLDKSKVINSALELLNEVGIEGLTTRKLAQKLGVEQPTLYWHVKNKRALLDALAIEMMDRHATHYCPLEGESWQDFLRNTAKSMRCALLSHRDGAKVCLGTRWTEQLYETAENQLAFLCQQGFSLENALYAVSAVRVFTLGCVLFDQELQVAKEERETPTTASMPPLLRQAWELKDHQGAEPAFLFGLELIICGLEKQLKCESGS

SEQ ID NO: 130 - protein, 208 aa, Artificial Sequence
  Sulfonylurea responsive repressor L6-4G03
MGSRLDKSKVINSALELLNEVGIEGLTTRKLAQKLGVEQPTLYWHVKNKRALLDALAIEMMDRHQTHYCPLEGESWQDFLRNNAKSMRCALLSHRDGAKVCLGTRWTEKHYEGAENQLAFLCQQGFSLENALYAMSAVRVFTLGCVLFDQESQVAKEERETPTTASMPPLVRQVWELKDHQGAEPAFLFGLELIICGLEKQLKCESGS

SEQ ID NO: 131 - protein, 208 aa, Artificial Sequence
  Sulfonylurea responsive repressor L6-4G06
MGSRLDKSKVINSALELLNEVGIEGLTTRKLAQKLGVEQPTLYWHVKNKRALLDALAIEMMDRHQTHMCPLEGESWQDFLRNNAKSMRCALLSHRDGAKVCLGTRWTEKHYETAENQLAFLCQQGFSLENALYAVSAVRVFTLGCVLFDQELQVAKEERETPTTASMPPLVRQAWELKDHQGAEPAFLFGLELIICGLEKQLKCESGS

SEQ ID NO: 132 - protein, 208 aa, Artificial Sequence
  Sulfonylurea responsive repressor L6-4G07
MGSRLDKSKVINSALELLNEVGIEGLTTRKLAQKLGVEQPTLYWHVKNKRALLDALAIEMMDRHATHLCPLEGESWQDFLRNNAKSMRCALLSHRDGAKVCLGTRWTEQQYETAENMLAFLCQQGFSLENALYAVSAVRNFTLGCVLFDQESQVAKEERETPTTASMPPLLRQAWELKDHQGAEPAFLLGLELIICGLEKQLKCESGS

SEQ ID NO: 133 - protein, 208 aa, Artificial Sequence
  Sulfonylurea responsive repressor L6-4G08
  misc_feature (152)..(152): Xaa can be any naturally occurring amino acid
MGSRLDKSKVINSALELLNEVGIEGLTTRKLAQKLGVEQPTLYWHVKNKRALLDALAIEMMDRHPTHYCPLEGESWQDFLRNNAKSMRCALLSHRDGAKVCLGTRWTEQQYETAENQLAFLCQQGFSLENALYAMSAVRNFTLGCVLFDQEXQVAKEERETPTTASMPPLLRQAWELKDHQGAEPAFLFGLELIICGLEKQLKCESGS

SEQ ID NO: 134 - protein, 208 aa, Artificial Sequence
  Sulfonylurea responsive repressor L6-4G10
MGSRLDKSKVINSALELLNEVGIEGLTTRKLAQKLGVEQPTLYWHVKNKRALLDALAIEMMDRHQTHFCPLEGESWQDFLRNTAKSMRCALLSHRDGAKVCLGTRWTEQQYETAENMLAFLCQQGFSLENALYAVSAVRVFTLGCVLFDQESQVAKEERETPTTASMPPLARQAWELKDHQGAEPAFLFGLELIICGLEKQLKCESGS

SEQ ID NO: 135 - protein, 208 aa, Artificial Sequence
  Sulfonylurea responsive repressor L6-4H07
MGSRLDKSKVINSALELLNEVGIEGLTTRKLAQKLGVEQPTLYWHVKNKRALLDALAIEMMDRHQTHVCPLEGESWQDFLRNNAKSMRCALLSHRDGAKVCLGTRWTEQMYETAENQLAFLCQQGFSLENALYAVSAVRVFTLGCVLFDQESQVAKEERETPTTASMPPLLRQAWELKDHQGAEPAFLFGLELIICGLEKQLKCESGS

SEQ ID NO: 136 - protein, 208 aa, Artificial Sequence
  Sulfonylurea responsive repressor L6-5A02
MGSRLDKSKVINSALELLNEVGIEGLTTRKLAQKLGVEQPTLYWHVKNKRALLDALAIEMMDRHATHYCPLEGESWQDFLRNTAKSMRCALLSHRDGAKVCLGTRWTEQLYETAENQLAFLCQQGFSLENALYAMSAVRVFTLGCVLFDQESQVAKEERETPTTASMPPLLRQAWELKDHQGAEPAFLFGLELIICGLEKQLKCESGS

SEQ ID NO: 137 - protein, 208 aa, Artificial Sequence
  Sulfonylurea responsive repressor L6-5A03
MGSRLDKSKVINSALELLNEVGIEGLTTRKLAQKLGVEQPTLYWHVKNKRALLDALAIEMMDRHATHYCPLEGESWQDFLRNNAKSMRCALLSHRDGAKVCLGTRWTEQLYETAENMLAFLCQQGFSLENALYAMSAVRVFTLGCVLFDQESQVAKEERETPTTASMPPLVRQGWELKDHQGAEPAFLFGLELIICGLEKQLKCESGS

SEQ ID NO: 138 - protein, 208 aa, Artificial Sequence
  Sulfonylurea responsive repressor L6-5A04
MGSRLDKSKVINSALELLNEVGIEGLTTRKLAQKLGVEQPTLYWHVKNKRALLDALAIEMMDRHQTHYCPLEGESWQDFLRNNAKSMRCALLSHRDGAKVWLGTRWTEKQYESAENMLAFLCQQGFSLENALYAVSAVRVFTLGCVLFDQELQVAKEERETPTTASMPPLVRQAWELKDHQGAEPAFLFGLELIICGLEKQLKCESGS

SEQ ID NO: 139 - protein, 208 aa, Artificial Sequence
  Sulfonylurea responsive repressor L6-5A05
MGSRLDKSKVINSALELLNEVGIEGLTTRKLAQKLGVEQPTLYWHVKNKRALLDALAIEMMDRHQTHMCPLEGESWQDFLRNTAKSMRCALLSHRDGAKVCLGTRWTEQMYEAAENQLAFLCQQGFSLENALYAMSAVRVFTLGCVLFDQESQVAKEERETPTTASMPPLVRQVWELKDHQGAEPAFLFGLELIICGLEKQLKCESGS

SEQ ID NO: 140 - protein, 208 aa, Artificial Sequence
  Sulfonylurea responsive repressor L6-5A06
MGSRLDKSKVINSALELLNEVGIEGLTTRKLAQKLGVEQPTLYWHVKNKRALLDALAIEMMDRHQTHYCPLEGESWQDFLRNTAKSMRCALLSHRDGAKVCLGTRWTEQMYETAENQLAFLCQQGFSLENALYAMSAVRVFTLGCVLFDQESQVAKEERETPTTASMPPLLRQVWELKDHQGAEPAFLFGLELIICGLEKQLKCESGS

SEQ ID NO: 141 - protein, 208 aa, Artificial Sequence
  Sulfonylurea responsive repressor L6-5A07
  misc_feature (109)..(109): Xaa can be any naturally occurring amino acid
  misc_feature (113)..(113): Xaa can be any naturally occurring amino acid
MGSRLDKSKVINSALELLNEVGIEGLTTRKLAQKLGVEQPTLYWHVKNKRALLDALAIEMMDRHQTHICPLEGESWQDFLRNTAKSMRCALLSHRDGAKVCLGTRWTEXQYEXAENMLAFLCQQGFSLENALYAMSAVRVFTLGCVLFDQELQVAKEERETPTTASMPPLVRQVWELKDHQGAEPAFLFGLELIICGLEKQLKCESGS

SEQ ID NO: 142 - protein, 208 aa, Artificial Sequence
  Sulfonylurea responsive repressor L6-5A09
MGSRLDKSKVINSALELLNEVGIEGLTTRKLAQKLGVEQPTLYWHVKNKRALLDALAIEMMDRHQTHMCPLEGESWQDFLRNNAKSMRCALLSHRDGAKVCLGTRWTEQHYEAAENQLAFLCQQGFSLENALYAMSAVRVFTLGCVLFDQESQVAKEERETPTTASMPPLVRQAWELKDHQGAEPAFLFGLELIICGLEKQLKCESGS

SEQ ID NO: 143 - protein, 208 aa, Artificial Sequence
  Sulfonylurea responsive repressor L6-5A10
  misc_feature (135)..(135): Xaa can be any naturally occurring amino acid
  misc_feature (171)..(171): Xaa can be any naturally occurring amino acid
MGSRLDKSKVINSALELLNEVGIEGLTTRKLAQKLGVEQPTLYWHVKNKRALLDALAIEMMDRHATHYCPLEGESWQDFLRNTAKSMRCALLSHRDGAKVCLGTRWTEQHYETAENQLAFLCQQGFSLENALYAXSAVRVFTLGCVLFDQELQVAKEERETPTTASMPPLXRQVWELKDHQGAEPAFLFGLELIICGLEKQLKCESGS

SEQ ID NO: 144 - protein, 208 aa, Artificial Sequence
  Sulfonylurea responsive repressor L6-5B02
  misc_feature (68)..(68): Xaa can be any naturally occurring amino acid
  misc_feature (113)..(113): Xaa can be any naturally occurring amino acid
  misc_feature (139)..(139): Xaa can be any naturally occurring amino acid
MGSRLDKSKVINSALELLNEVGIEGLTTRKLAQKLGVEQPTLYWHVKNKRALLDALAIEMMDRHQTHXCPLEGESWQDFLRNTAKSMRCALLSHRDGAKVCLGTRWTEQLYEXAENQLAFLCQQGFSLENALYAMSAVXVFTLGCVLFDQELQVAKEERETPTTASMPPLSRQVWELKDHQGAEPAFLFGLELIICGLEKQLKCESGS

SEQ ID NO: 145 - protein, 208 aa, Artificial Sequence
  Sulfonylurea responsive repressor L6-5B07
MGSRLDKSKVINSALELLNEVGIEGLTTRKLAQKLGVEQPTLYWHVKNKRALLDALAIEMMDRHATHICPLEGESWQDFLRNNAKSMRCALLSHRDGAKVCLGTRWTEQQYEAAENMLAFLCQQGFSLENALYAMSAVRVFTLGCVLFDQELQVAKEERETPTTASMPPLLRQVWELKDHQGAEPAFLFGLELIICGLEKQLKCESGS

SEQ ID NO: 146 - protein, 208 aa, Artificial Sequence
  Sulfonylurea responsive repressor L6-5B08
MGSRLDKSKVINSALELLNEVGIEGLTTRKLAQKLGVEQPTLYWHVKNKRALLDALAIEMMDRHQTHICPLEGESWQDFLRNNAKSMRCALLSHRDGAKVCLGTRWTEQQYETAENQLAFLCQQGFSLENALYAMSAVRVFTLGCVLFDQESQVAKEERETPTTASMPPLVRQGWELKDHQGAEPAFLFGLELIICGLEKQLKCESGS

SEQ ID NO: 147 - protein, 208 aa, Artificial Sequence
  Sulfonylurea responsive repressor L6-5B11
MGSRLDKSKVINSALELLNEVGIEGLTTRKLAQKLGVEQPTLYWHVKNKRALLDALAIEMMDRHQTHVCPLEGESWQDFLRNNAKSMRCALLSHRDGAKVCLGTRWTEQQYESAENMLAFLCQQGFSLENALYAMSAVRVFTLGCVLFDQESQVAKEERETPTTASMPPLLRQVLELKDHQGAEPAFLFGLELIICGLEKQLKCESGS

SEQ ID NO: 148 - protein, 208 aa, Artificial Sequence
  Sulfonylurea responsive repressor L6-5C01
MGSRLDKSKVINSALELLNEVGIEGLTTRKLAQKLGVEQPTLYWHVKNKRALLDALAIEMMDRHATNYCPLEGESWQDFLRNTAKSMRCALLSHRDGAKVCLGTRWTEQQYETAENMLAFLCQQGFSLENALYAVSAVRVFTLGCVLFDQELQVAKEERETPTTASMPPLLRQVWELKDHQGAEPAFLFGLELIICGLEKQLKCESGS

SEQ ID NO: 149 - protein, 208 aa, Artificial Sequence
  Sulfonylurea responsive repressor L6-5C02
MGSRLDKSKVINSALELLNEVGIEGLTTRKLAQKLGVEQPTLYWHVKNKRALLDALAIEMMDRHQTHFCPLEGESWQDFLRNTAKSMRCALLSHRDGAKVWLGTRWTEKQYETAENQLAFLCQQGFSLENALYAVSAVRVFTLGCVLFDQELQVAKEERETPTTASMPPLLRQAWELKDHQGAEPAFLFGLELIICGLEKQLKCESGS

SEQ ID NO: 150 - protein, 208 aa, Artificial Sequence
  Sulfonylurea responsive repressor L6-5C04
  misc_feature (109)..(110): Xaa can be any naturally occurring amino acid
  misc_feature (113)..(113): Xaa can be any naturally occurring amino acid
  misc_feature (139)..(140): Xaa can be any naturally occurring amino acid
  misc_feature (171)..(171): Xaa can be any naturally occurring amino acid
  misc_feature (174)..(174): Xaa can be any naturally occurring amino acid
MGSRLDKSKVINSALELLNEVGIEGLTTRKLAQKLGVEQPTLYWHVKNKRALLDALAIEMMDRHQTHYCPLEGESWQDFLRNTAKSMRCALLSHRDGAKVCLGTRWTEXXYEXAENQLAFLCQQGFSLENALYAMSAVXXFTLGCVLFDQESQVAKEERETPTTASMPPLXRQXWELKDHQGAEPAFLFGLELIICGLEKQLKCESGS

SEQ ID NO: 151 - protein, 208 aa, Artificial Sequence
  Sulfonylurea responsive repressor L6-5C08
MGSRLDKSKVINSALELLNEVGIEGLTTRKLAQKLGVEQPTLYWHVKNKRALLDALAIEMMDRHQTHYCPLEGESWQDFLRNNAKSMRCALLSHRDGAKVCLGTRWTEQLYETAENMLAFLCQQGFSLENALYAMSAVRVFTLGCVLFDQESQVAKEERETPTTASMPPLLRQVWELKDHQGAEPAFLFGLELIICGLEKQLKCESGS

SEQ ID NO: 152 - protein, 208 aa, Artificial Sequence
  Sulfonylurea responsive repressor L6-5C10
MGSRLDKSKVINSALELLNEVGIEGLTTRKLAQKLGVEQPTLYWHVKNKRALLDALAIEMMDRHATHLCPLEGESWQDFLRNTAKSMRCALLSHRDGAKVCLGTRWTEQQYEAAENMLAFLCQQGFSLENALYAMSAVRVFTLGCVLFDQESQVAKEERETPTTASMPPLLRQVWELKDHQGAEPAFLFGLELIICGLEKQLKCESGS

SEQ ID NO: 153 - protein, 208 aa, Artificial Sequence
  Sulfonylurea responsive repressor L6-5C11
MGSRLDKSKVINSALELLNEVGIEGLTTRKLAQKLGVEQPTLYWHVKNKRALLDALAIEMMDRHQTHYCPLEGESWQDFLRNNAKSMRCALLSHRDGAKVCLGTRWTEKHYESAENMLAFLCQQGFSLENALYAMSAVRVFTLGCVLFDQELQVAKEERETPTTASMPPLLRQVWELKDHQGAEPAFLFGLELIICGLEKQLKCESGS

SEQ ID NO: 154 - protein, 208 aa, Artificial Sequence
  Sulfonylurea responsive repressor L6-5D04
MGSRLDKSKVINSALELLNEVGIEGLTTRKLAQKLGVEQPTLYWHVKNKRALLDALAIEMMDRHQTHYCPLEGESWQDFLRNNAKSMRCALLSHRDGAKVCLGTRWTEQHYETAENQLAFLCQQGFSLENALYAMSAVRVFTLGCVLFDQESQVAKEERETPTTASMPPLVRQGWELKDHQGAEPAFLFGLELIICGLEKQLKCESGS

SEQ ID NO: 155 - protein, 208 aa, Artificial Sequence
  Sulfonylurea responsive repressor L6-5D09
MGSRLDKSKVINSALELLNEVGIEGLTTRKLAQKLGVEQPTLYWHVKNKRALLDALAIEMMDRHATHYCPLEGESWQDFLRNNAKSMRCALLSHRDGAKVCLGTRWTEKQYEAAENQLAFLCQQGFSLENALYAVSAVRVFTLGCVLFDQESQVAKEERETPTTASMPPLLRQGWELKDHQGAEPAFLFGLELIICGLEKQLKCESGS

SEQ ID NO: 156 - protein, 208 aa, Artificial Sequence
  Sulfonylurea responsive repressor L6-5D11
MGSRLDKSKVINSALELLNEVGIEGLTTRKLAQKLGVEQPTLYWHVKNKRALLDALAIEMMDRHATHYCPLEGESWQDFLRNNAKSMRCALLSHRDGAKVCLGTRWTEQLYEAAENQLAFLCQQGFSLENALYAMSAVRVFTLGCVLFDQESQVAKEERETPTTASMPPLVRQVWELKDHQGAEPAFLFGLELIICGLEKQLKCESGS

SEQ ID NO: 157 - protein, 208 aa, Artificial Sequence; identical to SEQ ID NO: 17
  Sulfonylurea responsive repressor L6-5D12

SEQ ID NO: 158 - protein, 208 aa, Artificial Sequence
  Sulfonylurea responsive repressor L6-5E05
MGSRLDKSKVINSALELLNEVGIEGLTTRKLAQKLGVEQPTLYWHVKNKRALLDALAIEMMDRHQTHYCPLEGESWQDFLRNNAKSMRCALLSHRDGAKVCLGTRWTEKHYETAENMLAFLCQQGFSLENALYAVSAVRVFTLGCVLFDQELQVAKEERETPTTASMPPLLRQVWELKDHQGAEPAFLFGLELIICGLEKQLKCESGS

SEQ ID NO: 159 - protein, 208 aa, Artificial Sequence
  Sulfonylurea responsive repressor L6-5E09
  misc_feature (65)..(65): Xaa can be any naturally occurring amino acid
  misc_feature (110)..(110): Xaa can be any naturally occurring amino acid
  misc_feature (113)..(113): Xaa can be any naturally occurring amino acid
  misc_feature (135)..(135): Xaa can be any naturally occurring amino acid
  misc_feature (171)..(171): Xaa can be any naturally occurring amino acid
MGSRLDKSKVINSALELLNEVGIEGLTTRKLAQKLGVEQPTLYWHVKNKRALLDALAIEMMDRHXTHYCPLEGESWQDFLRNTAKSMRCALLSHRDGAKVWLGTRWTEQXYEXAENLLAFLCQQGFSLENALYAXSAVRNFTLGCVLFDQESQVAKEERETPTTASMPPLXRQGWELKDHQGAEPAFLFGLELIICGLEKQLKCESGS

SEQ ID NO: 160 - protein, 208 aa, Artificial Sequence
  Sulfonylurea responsive repressor L6-5F02
MGSRLDKSKVINSALELLNEVGIEGLTTRKLAQKLGVEQPTLYWHVKNKRALLDALAIEMMDRHQTHICPLEGESWQDFLRNTAKSMRCALLSHRDGAKVCLGTRWTEKHYEAAENMLAFLCQQGFSLENALYAVSAVRVFTLGCVLFDQESQVAKEERETPTTASMPPLVRQVWELKDHQGAEPAFLFGLELIICGLEKQLKCESGS

SEQ ID NO: 161 - protein, 208 aa, Artificial Sequence
  Sulfonylurea responsive repressor L6-5F04
MGSRLDKSKVINSALELLNEVGIEGLTTRKLAQKLGVEQPTLYWHVKNKRALLDALAIEMMDRHQTHYCPLEGESWQDFLRNNAKSMRCALLSHRDGAKVCLGTRWTEQLYESAENQLAFLCQQGFSLENALYAMSAVRVFTLGCVLFDQELQVAKEERETPTTASMPPLLRQGWELKDHQGAEPAFLFGLELIICGLEKQLKCESGS

SEQ ID NO: 162 - protein, 208 aa, Artificial Sequence
  Sulfonylurea responsive repressor L6-5F05
MGSRLDKSKVINSALELLNEVGIEGLTTRKLAQKLGVEQPTLYWHVKNKRALLDALAIEMMDRHATHICPLEGESWQDFLRNNAKSMRCALLSHRDGAKVCLGTRWTEQQYEAAENQLAFLCQQGFSLENALYAVSAVRVFTLGCVLFDQELQVAKEERETPTTASMPPLLRQAWELKDHQGAEPAFLFGLELIICGLEKQLKCESGS

SEQ ID NO: 163 - protein, 208 aa, Artificial Sequence
  Sulfonylurea responsive repressor L6-5F07
MGSRLDKSKVINSALELLNEVGIEGLTTRKLAQKLGVEQPTLYWHVKNKRALLDALAIEMMDRHATHYCPLEGESWQDFLRNNAKSMRCALLSHRDGAKVCLGTRWTEKQYETAENQLAFLCQQGFSLENALYAVSAVRVFTLGCVLFDQELQVAKEERETPTTASMPPLLRQVWELKDHQGAEPAFLFGLELIICGLEKQLKCESGS

SEQ ID NO: 164 - protein, 208 aa, Artificial Sequence
  Sulfonylurea responsive repressor L6-5F08
MGSRLDKSKVINSALELLNEVGIEGLTTRKLAQKLGVEQPTLYWHVKNKRALLDALAIEMMDRHATHYCPLEGESWQDFLRNNAKSMRCALLSHRDGAKVCLGTRWTEKHYETAENQLAFLCQQGFSLENALYAMSAVRVFTLGCVLFDQESQVAKEERETPTTASMPPLLRQVWELKDHQGAEPAFLFGLELIICGLEKQLKCESGS

SEQ ID NO: 165 - protein, 208 aa, Artificial Sequence
  Sulfonylurea responsive repressor L6-5F10
  misc_feature (110)..(110): Xaa can be any naturally occurring amino acid
MGSRLDKSKVINSALELLNEVGIEGLTTRKLAQKLGVEQPTLYWHVKNKRALLDALAIEMMDRHQTHYCPLEGESWQDFLRNNAKSMRCALLSHRDGAKVWLGTRWTEQXYEAAENMLAFLCQQGFSLENALYAVSAVGVFTLGCVLFDQELQVAKEERETPTTASMPPLARQVLELKDHQGAEPAFLFGLELIICGLEKQLKCESGS

SEQ ID NO: 166 - protein, 208 aa, Artificial Sequence
  Sulfonylurea responsive repressor L6-5F12
MGSRLDKSKVINSALELLNEVGIEGLTTRKLAQKLGVEQPTLYWHVKNKRALLDALAIEMMDRHATHYCPLEGESWQDFLRNNAKSMRCALLSHRDGAKVCLGTRWTEKLYEAAENMLAFLCQQGFSLENALYAVSAVRVFTLGCVLFDQESQVAKEERETPTTASMPPLLRQVWELKDHQGAEPAFLFGLELIICGLEKQLKCESGS

SEQ ID NO: 167 - protein, 208 aa, Artificial Sequence
  Sulfonylurea responsive repressor L6-5G03
MGSRLDKSKVINSALELLNEVGIEGLTTRKLAQKLGVEQPTLYWHVKNKRALLDALAIEMMDRHATHMCPLEGESWQDFLRNNAKSMRCALLSHRDGAKVWLGTRWTEQQYETAENMLAFLCQQGFSLENALYAVSAVRVFTLGCVLFDQELQVAKEERETPTTASMPPLLRQVWELKDHQGAEPAFLFGLELIICGLEKQLKCESGS

SEQ ID NO: 168 - protein, 208 aa, Artificial Sequence
  Sulfonylurea responsive repressor L6-5G05
MGSRLDKSKVINSALELLNEVGIEGLTTRKLAQKLGVEQPTLYWHVKNKRALLDALAIEMMDRHQTHYCPLEGESWQDFLRNNAKSMRCALLSHRDGAKVCLGTRWTEKQYETAENQLAFLCQQGFSLENALYAMSAVRNFTLGCVLFDQESQVAKEERETPTTASMPPLLRQAWELKDHQGAEPAFLFGLELIICGLEKQLKCESGS

SEQ ID NO: 169 - protein, 208 aa, Artificial Sequence
  Sulfonylurea responsive repressor L6-5G06
MGSRLDKSKVINSALELLNEVGIEGLTTRKLAQKLGVEQPTLYWHVKNKRALLDALAIEMMDRHQTHYCPLEGESWQDFLRNNAKSMRCALLSHRDGAKVCLGTRWTEQQYETAENQLAFLCQQGFSLENALYAVSAVRVFTLGCVLFDQELQVAKEERETPTTASMPPLLRQGWELKDHQGAEPAFLFGLELIICGLEKQLKCESGS

SEQ ID NO: 170 - protein, 208 aa, Artificial Sequence
  Sulfonylurea responsive repressor L6-5G08
MGSRLDKSKVINSALELLNEVGIEGLTTRKLAQKLGVEQPTLYWHVKNKRALLDALAIEMMDRHQTHICPLEGESWQDFLRNNAKSMRCALLSHRDGAKVCLGTRWTEKLYETAENQLAFLCQQGFSLENALYAMSAVRVFTLGCVLFDQELQVAKEERETPTTASMPPLVRQVWELKDHQGAEPAFLFGLELIICGLEKQLKCESGS

SEQ ID NO: 171 - protein, 208 aa, Artificial Sequence
  Sulfonylurea responsive repressor L6-5G11
MGSRLDKSKVINSALELLNEVGIEGLTTRKLAQKLGVEQPTLYWHVKNKRALLDALAIEMMDRHQTHICPLEGESWQDFLRNNAKSMRCALLSHRDGAKVCLGTRWTEKQYESAENMLAFLCQQGFSLENALYAVSAVRVFTLGCVLFDQELQVAKEERETPTTASMPPLVRQVWELKDHQGAEPAFLFGLELIICGLEKQLKCESGS

SEQ ID NO: 172 - protein, 208 aa, Artificial Sequence
  Sulfonylurea responsive repressor L6-5G12
MGSRLDKSKVINSALELLNEVGIEGLTTRKLAQKLGVEQPTLYWHVKNKRALLDALAIEMMDRHATHLCPLEGESWQDFLRNNAKSMRCALLSHRDGAKVCLGTRWTEKQYEAAENQLAFLCQQGFSLENALYAVSAVRVFTLGCVLFDQESQVAKEERETPTTASMPPLLRQVWELKDHQGAEPAFLFGLELIICGLEKQLKCESGS

SEQ ID NO: 173 - protein, 208 aa, Artificial Sequence
  Sulfonylurea responsive repressor L6-5H03
MGSRLDKSKVINSALELLNEVGIEGLTTRKLAQKLGVEQPTLYWHVKNKRALLDALAIEMMDRHATHLCPLEGESWQDFLRNNAKSMRCALLSHRDGAKVCLGTRWTEQLYETAENMLAFLCQQGFSLENALYAVSAVRNFTLGCVLFDQESQVAKEERETPTTASMPPLLRQVWELKDHQGSEPAFLFGLELIICGLEKQLKCESGS

SEQ ID NO: 174 - protein, 208 aa, Artificial Sequence
  Sulfonylurea responsive repressor L6-5H06
MGSRLDKSKVINSALELLNEVGIEGLTTRKLAQKLGVEQPTLYWHVKNKRALLDALAIEMMDRHQTHICPLEGESWQDFLRNNAKSMRCALLSHRDGAKVCLGTRWTEKQYETAENMLAFLCQQGFSLENALYAVSAVRVFTLGCVLFDQELQVAKEERETPTTASMPPLVRQAWELKDHQGAEPAFLFGLELIICGLEKQLKCESGS

SEQ ID NO: 175 - protein, 208 aa, Artificial Sequence
  Sulfonylurea responsive repressor L6-5H07
MGSRLDKSKVINSALELLNEVGIEGLTTRKLAQKLGVEQPTLYWHVKNKRALLDALAIEMMDRHQTHMCPLEGESWQDFLRNNAKSMRCALLSHRDGAKVCLGTRWTEQQYEAAENMLAFLCQQGFSLENALYAMSAVRNFTLGCVLFDQESQVAKEERETPTTASMPPLLRQAWELKDHQGAEPAFLFGLELIICGLEKQLKCESGS

SEQ ID NO: 176 - protein, 208 aa, Artificial Sequence
  Sulfonylurea responsive repressor L6-5H12
MGSRLDKSKVINSALELLNEVGIEGLTTRKLAQKLGVEQPTLYWHVKNKRALLDALAIEMMDRHATHYCPLEGESWQDFLRNNAKSMRCALLSHRDGAKVCLGTRWTEKQYETAENQLAFLCQQGFSLENALYAMSAVRVFTLGCVLFDQELQVAKEERETPTTASMPPLVRQAWELKDHQGAEPAFLFGLELIICGLEKQLKCESGS

SEQ ID NO: 177 - protein, 208 aa, Artificial Sequence
  Sulfonylurea responsive repressor L6-6A09
MGSRLDKSKVINSALELLNEVGIEGLTTRKLAQKLGVEQPTLYWHVKNKRALLDALAIEMMDRHQTHYCPLEGESWQDFLRNTAKSMRCALLSHRDGAKVCLGTRWTEKQYETAENMLAFLCQQGFSLENALYAVSAVRVFTLGCVLFDQESQVAKEERETPTTASMPPLLRQGLELKDHQGAEPAFLFGLELIICGLEKQLKCESGS

SEQ ID NO: 178 - protein, 208 aa, Artificial Sequence
  Sulfonylurea responsive repressor L6-6B01
  misc_feature (65)..(65): Xaa can be any naturally occurring amino acid
MGSRLDKSKVINSALELLNEVGIEGLTTRKLAQKLGVEQPTLYWHVKNKRALLDALAIEMMDRHXTHYCPLEGESWQDFLRNNAKSMRCALLSHRDGAKVCLGTRWTEKHYETAENMLAFLCQQGFSLENALYAMSAVRNFTLGGVLFDQESQVAKEERETPTTASMPPLARQVWELKDHQGAEPAFLFGLELIICGLEKQLKCESGS

SEQ ID NO: 179 - protein, 208 aa, Artificial Sequence
  Sulfonylurea responsive repressor L6-6B03
MGSRLDKSKVINSALELLNEVGIEGLTTRKLAQKLGVEQPTLYWHVKNKRALLDALAIEMMDRHQTHICPLEGESWQDFLRNNAKSMRCALLSHRDGAKVCLGTRWTEKMYETAENQLAFLCQQGFSLENALYAMSAVRVFTLGCVLFDQELQVAKEERETPTTASMPPLLRQAWELKDHQGAEPAFLFGLELIICGLEKQLKCESGS

SEQ ID NO: 180 - protein, 208 aa, Artificial Sequence
  Sulfonylurea responsive repressor L6-6B04
MGSRLDKSKVINSALELLNEVGIEGLTTRKLAQKLGVEQPTLYWHVKNKRALLDALAIEMMDRHQTHYCPLEGESWQDFLRNTAKSMRCALLSHRDGAKVCLGTRWTEQQYETAENMLAFLCQQGFSLENALYAVSAVRVFTLGCVLFDQESQVAKEERETPTTASMPPLLRQAWELKDHQGAEPAFLFGLELIICGLEKQLKCESGS

SEQ ID NO: 181 - protein, 208 aa, Artificial Sequence
  Sulfonylurea responsive repressor L6-6B05
MGSRLDKSKVINSALELLNEVGIEGLTTRKLAQKLGVEQPTLYWHVKNKRALLDALAIEMMDRHATHYCPLEGESWQDFLRNNAKSMRCALLSHRDGAKVCLGTRWTEQHYETAENQLAFLCQQGFSLENALYAVSAVRVFTLGCVLFDQESQVAKEERETPTTASMPPLLRQVWELKDHQGAEPAFLFGLELIICGLEKQLKCESGS

SEQ ID NO: 182 - protein, 208 aa, Artificial Sequence
  Sulfonylurea responsive repressor L6-6B10
MGSRLDKSKVINSALELLNEVGIEGLTTRKLAQKLGVEQPTLYWHVKNKRALLDALAIEMMDRHATHLCPLEGESWQDFLRNNAKSMRCALLSHRDGAKVCLGTRWTEKQYETAENQLAFLCQQGFSLENALYAVSAVRVFTLGCVLFDQESQVAKEERETPTTASMPPLLRQVWELKDHQGAEPAFLFGLELIICGLEKQLKCESGS

SEQ ID NO: 183 - protein, 208 aa, Artificial Sequence
  Sulfonylurea responsive repressor L6-6C01
MGSRLDKSKVINSALELLNEVGIEGLTTRKLAQKLGVEQPTLYWHVKNKRALLDALAIEMMDRHQTHYCPLEGESWQDFLRNNAKSMRCALLSHRDGAKVCLGTRWTEQQYETAENMLAFLCQQGFSLENALYAMSAVRVFTLGCVLFDQESQVAKEERETPTTASMPPLLRQALELKDHQGAEPAFLFGLELIICGLEKQLKCESGS

SEQ ID NO: 184 - protein, 208 aa, Artificial Sequence
  Sulfonylurea responsive repressor L6-6C02
MGSRLDKSKVINSALELLNEVGIEGLTTRKLAQKLGVEQPTLYWHVKNKRALLDALAIEMMDRHQTHFCPLEGESWQDFLRNTAKSMRCALLSHRDGAKVCLGTRWTEQLYEAAENMLAFLCQQGFSLENALYAVSAVRVFTLGCVLFDQESQVAKEERETPTTASMPPLLRQGWELKDHQGAEPAFLFGLELIICGLEKQLKCESGS

SEQ ID NO: 185 - protein, 208 aa, Artificial Sequence
  Sulfonylurea responsive repressor L6-6C04
MGSRLDKSKVINSALELLNEVGIEGLTTRKLAQKLGVEQPTLYWHVKNKRALLDALAIEMMDRHATHLCPLEGESWQDFLRNNAKSMRCALLSHRDGAKVCLGTRWTEQLYETAENQLAFLCQQGFSLENALYAVSAVRVFTLGCVLFDQESQVAKEERETPTTASMPPLLRQVWELKDHQGAEPAFLFGLELIICGLEKQLKCESGS

SEQ ID NO: 186 - protein, 208 aa, Artificial Sequence
  Sulfonylurea responsive repressor L6-6C05
MGSRLDKSKVINSALELLNEVGIEGLTTRKLAQKLGVEQPTLYWHVKNKRALLDALAIEMMDRHQTHYCPLEGESWQDFLRNNAKSMRCALLSHRDGAKVCLGTRWTEQMYEGAENMLAFLCQQGFSLENALYAVSAVRNFTLGCVLFDQESQVAKEERETPTTASMPPLLRQAWELKDHQGAEPAFLFGLELIICGLEKQLKCESGS

SEQ ID NO: 187 - protein, 208 aa, Artificial Sequence
  Sulfonylurea responsive repressor L6-6C06
MGSRLDKSKVINSALELLNEVGIEGLTTRKLAQKLGVEQPTLYWHVKNKRALLDALAIEMMDRHATHYCPLEGESWQDFLRNNAKSMRCALLSHRDGAKVCLGTRWTEQQYETAENQLAFLCQQGFSLENALYAMSAVRVFTLGCVLFDQESQVAKEERETPTSASMPPLVRQVWELKDHQGAEPAFLFGLELIICGLEKQLKCESGS

SEQ ID NO: 188 - protein, 208 aa, Artificial Sequence
  Sulfonylurea responsive repressor L6-6C07
MGSRLDKSKVINSALELLNEVGIEGLTTRKLAQKLGVEQPTLYWHVKNKRALLDALAIEMMDRHQTHYCPLEGESWQDFLRNTAKSMRCALLSHRDGAKVCLGTRWTEKQYEAAENMLAFLCQQGFSLENALYAMSAVRVFTLGCVLFDQESQVAKEERETPTTASMPPLLRQAWELKDHQGAEPAFLFGLELIICGLEKQLKCESGS

SEQ ID NO: 189 - protein, 208 aa, Artificial Sequence
  Sulfonylurea responsive repressor L6-6C10
MGSRLDKSKVINSALELLNEVGIEGLTTRKLAQKLGVEQPTLYWHVKNKRALLDALAIEMMDRHQTHLCPLEGESWQDFLRNNAKSMRCALLSHRDGAKVCLGTRWTEQLYEAAENMLAFLCQQGFSLENALYAVSAVRVFTLGCVLFDQESQVAKEERETPTTASMPPLVRQGWELKDHQGAEPAFLFGLELIICGLEKQLKCESGS

SEQ ID NO: 190 - protein, 208 aa, Artificial Sequence
  Sulfonylurea responsive repressor L6-6C11
MGSRLDKSKVINSALELLNEVGIEGLTTRKLAQKLGVEQPTLYWHVKNKRALLDALAIEMMDRHQTHYCPLEGESWQDFLRNTAKSMRCALLSHRDGAKVCLGTRWTEQLYETAENQLAFLCQQGFSLENALYAMSAVRVFTLGCVLFDQESQVAKEERETPTTASMPPLLRQGWELKDHQGAEPAFLFGLELIICGLEKQLKCESGS

SEQ ID NO: 191 - protein, 208 aa, Artificial Sequence
  Sulfonylurea responsive repressor L6-6D02
MGSRLDKSKVINSALELLNEVGIEGLTTRKLAQKLGVEQPTLYWHVKNKRALLDALAIEMMDRHQTHYCPLEGESWQDFLRNTAKSMRCALLSHRDGAKVCLGTRWTEQHYEAAENMLAFLCQQGFSLENALYAMSAVRVFTLGCVLFDQESQVAKEERETPTTASMPPLLRQAWELKDHQGAEPAFLLGLELIICGLEKQLKCESGS

SEQ ID NO: 192 - protein, 208 aa, Artificial Sequence
  Sulfonylurea responsive repressor L6-6D06
MGSRLDKSKVINSALELLNEVGIEGLTTRKLAQKLGVEQPTLYWHVKNKRALLDALAIEMMDRHQTHMCPLEGESWQDFLRNNAKSMRCALLSHRDGAKVCLGTRWTEKQYEGAENQLAFLCQQGFSLENALYAVSAVRVFTLGCVLFDQESQVAKEERETPTTASMPPLVRQVWELKDHQGAEPAFLFGLELIICGLEKQLKCESGS

SEQ ID NO: 193 - protein, 208 aa, Artificial Sequence
  Sulfonylurea responsive repressor L6-6D07
MGSRLDKSKVINSALELLNEVGIEGLTTRKLAQKLGVEQPTLYWHVKNKRALLDALAIEMMDRHQTHICPLEGESWQDFLRNNAKSMRCALLSHRDGAKVCLGTRWTEQQYEGAENQLAFLCQQGFSLENALYAMSAVRVFTLGCVLFDQESQVAKEERETPTTASMPPLLRQGWELKDHQGAEPAFLFGLELIICGLEKQLKCESGS

SEQ ID NO: 194 - protein, 208 aa, Artificial Sequence
  Sulfonylurea responsive repressor L6-6D09
MGSRLDKSKVINSALELLNEVGIEGLTTRKLAQKLGVEQPTLYWHVKNKRALLDALAIEMMDRHATHMCPLEGESWQDFLRNNAKSMRCALLSHRDGAKVCLGTRWTEQHYETAENQLAFLCQQGFSLENALYAVSAVRVFTLGCVLFDQESQVAKEERETPTTASMPPLLRQGWELKDHQGAEPAFLFGLELIICGLEKQLKCESGS

SEQ ID NO: 195 - protein, 208 aa, Artificial Sequence
  Sulfonylurea responsive repressor L6-6D10
MGSRLDKSKVINSALELLNEVGIEGLTTRKLAQKLGVEQPTLYWHVKNKRALLDALAIEMMDRHATHICPLEGESWQDFLRNNAKSMRCALLSHRDGAKVCLGTRWTEQQYETAENMLAFLCQQGFSLENALYAVSAVRVFTLGCVLFDQESQVAKEERETPTTASMPPLVRQALELKDHQGAEPAFLFGLELIICGLEKQLKCESGS

SEQ ID NO: 196 - protein, 208 aa, Artificial Sequence
  Sulfonylurea responsive repressor L6-6D12
MGSRLDKSKVINSALELLNEVGIEGLTTRKLAQKLGVEQPTLYWHVKNKRALLDALAIEMMDRHATHFCPLEGESWQDFLRNNAKSMRCALLSHRDGAKVWLGTRWTEQQYETAENMLAFLCQQGFSLENALYAVSAVRVFTLGCVLFDQERQVAKEERETPTTASMPPLLRQVWELKDHQGAEPAFLFGLELIICGLEKQLKCESGS

SEQ ID NO: 197 - protein, 208 aa, Artificial Sequence
  Sulfonylurea responsive repressor L6-6E01
MGSRLDKSKVINSALELLNEVGIEGLTTRKLAQKLGVEQPTLYWHVKNKRALLDALAIEMMDRHQTHFCPLEGESWQDFLRNNAKSMRCALLSHRDGAKVCLGTRWTEQQYEAAENQLAFLCQQGFSLENALYAMSAVRNFTLGCVLFDQELQVAKEERETPTTASMPPLLRQVWELKDHQGAEPAFLFGLELIICGLEKQLKCESGS

SEQ ID NO: 198 - protein, 208 aa, Artificial Sequence
  Sulfonylurea responsive repressor L6-6E02
MGSRLDKSKVINSALELLNEVGIEGLTTRKLAQKLGVEQPTLYWHVKNKRALLDALAIEMMDRHQTHVCPLEGESWQDFLRNNAKSMRCALLSHRDGAKVCLGTRWTEQMYETAENMLAFLCQQGFSLENALYAMSAVRVFTLGCVLFDQELQVAKEERETPTTASMPPLLRQAWELKDHQGAEPAFLFGLELIICGLEKQLKCESGS

SEQ ID NO: 199 - protein, 208 aa, Artificial Sequence
  Sulfonylurea responsive repressor L6-6E03
  misc_feature (146)..(146): Xaa can be any naturally occurring amino acid
  misc_feature (201)..(201): Xaa can be any naturally occurring amino acid
MGSRLDKSKVINSALELLNEVGIEGLTTRKLAQKLGVEQPTLYWHVKNKRALLDALAIEMMDRHQTHYCPLEGESWQDFLRNNAKSMRCALLSHRDGAKVCLGTRWTEQHYETAENQLAFLCQQGFSLENALYAMSAVRVFTLGCXLFDQESQVAKEERETPTTASMPPLVRQVWELKDHQGAEPAFLFGLELIICGLEKXLKCESGS

SEQ ID NO: 200 - protein, 208 aa, Artificial Sequence
  Sulfonylurea responsive repressor L6-6E11
MGSRLDKSKVINSALELLNEVGIEGLTTRKLAQKLGVEQPTLYWHVKNKRALLDALAIEMMDRHQTHYCPLEGESWQDFLRNTAKSMRCALLSHRDGAKVCLGTRWTEQHYEGAENMLAFLCQQGFSLENALYAVSAVRVFTLGCVLFDQELQVAKEERETPTTASMPPLVRQGWELKDHQGAEPAFLFGLELIICGLEKQLKCESGS

SEQ ID NO: 201 - protein, 208 aa, Artificial Sequence
  Sulfonylurea responsive repressor L6-6F03
MGSRLDKSKVINSALELLNEVGIEGLTTRKLAQKLGVEQPTLYWHVKNKRALLDALAIEMMDRHQTHVCPLEGESWQDFLRNNAKSMRCALLSHRDGAKVCLGTRWTEQQYEAAENQLAFLCQQGFSLENALYAMSAVRVFTLGCVLFDQELQVAKEERETPTTASMPPLLRQVWELKDHQGAEPAFLFGLELIICGLEKQLKCESGS

SEQ ID NO: 202 - protein, 208 aa, Artificial Sequence
  Sulfonylurea responsive repressor L6-6F07
MGSRLDKSKVINSALELLNEVGIEGLTTRKLAQKLGVEQPTLYWHVKNKRALLDALAIEMMDRHATHLCPLEGESWQDFLRNTAKSMRCALLSHRDGAKVCLGTRWTEQQYESAENMLAFLCQQGFSLENALYAMSAVRVFTLGCVLFDQESQVAKEERETPTTASMPPLLRQAWELKDHQGAEPAFLFGLELIICGLEKQLKCESGS

SEQ ID NO: 203 - protein, 208 aa, Artificial Sequence
  Sulfonylurea responsive repressor L6-6F08
MGSRLDKSKVINSALELLNEVGIEGLTTRKLAQKLGVEQPTLYWHVKNKRALLDALAIEMMDRHQTHYCPLEGESWQDFLRNTAKSMRCALLSHRDGAKVCLGTRWTEQQYESAENQLAFLCQQGFSLENALYAVSAVRVFTLGCVLFDQELQVAKEERETPTTASMPPLLRQVWELKDHQGAEPAFLFGLELIICGLEKQLKCESGS

SEQ ID NO: 204 - protein, 208 aa, Artificial Sequence
  Sulfonylurea responsive repressor L6-6G01
MGSRLDKSKVINSALELLNEVGIEGLTTRKLAQKLGVEQPTLYWHVKNKRALLDALAIEMMDRHATHVCPLEGESWQDFLRNTAKSMRCALLSHRDGAKVCLGTRWTEQQYETAENMLAFLCQQGFSLENALYAMSAVRVFTLGCVLFDQESQVAKEERETPTTASMPPLLRQVWELKDHQGAEPAFLFGLELIICGLEKQLKCESGS

SEQ ID NO: 205 - protein, 208 aa, Artificial Sequence
  Sulfonylurea responsive repressor L7-1A01
MGSRLDKSKVINSALELLNEVGIEGLTTRKLAQKLGVEQPTLYWHVKNKRALLDALAIEMLDRHATHYCPLEGESWQDFLRNNAKSMRCALLSHRDGAKVCLGTGFTEKQYETAENSLAFLCQQGFSLEHAMYAMQAAGIYTLGCVLLDQELQVAKEERETPTTDSMPPLVRQVLELKDHQGAEPAFLFGLELIICGLEKQLKCESGS

SEQ ID NO: 206 - protein, 208 aa, Artificial Sequence
  Sulfonylurea responsive repressor L7-1B01
MGSRLDKSKAINSALELLNEVGIEGLTTRKLAQKLGVEQPTLYWHVKNKRALLDAMAIEMLDRHATHYCPLEGESWQDFLRNNAKSMRCALLSHRDGAKVCLGTGFTEQQYEAAENSMAFLCQQGFSLEHALYAMQAAGIFTLGCVLLDQELQVAKEERETPTTDSMPPLVRQVLELKDHQGAEPAFLFGLELIICGLEKQLKCESGS

SEQ ID NO: 207 - protein, 208 aa, Artificial Sequence
  Sulfonylurea responsive repressor L7-1C01
MGSRLDKSKVINSALELLNEVGIEGLTTRKLAQKLGVEQPTLYWHVKNKRALLDALAIEMLDRHATHYCPLEGESWQDFLRNNAKSMRCALLSHRDGAKVCLGTGFTEQMYEAAENSMAFLCQQGFSLEHAMYAMQAVGIYTLGCVLLDQELQVAKEERETPTTDSMPPLVRQVLELKDHQGAEPAFLFGLELIICGLEIQLKCESGS

SEQ ID NO: 208 - protein, 208 aa, Artificial Sequence
  Sulfonylurea responsive repressor L7-1D01
  misc_feature (10)..(10): Xaa can be any naturally occurring amino acid
MGSRLDKSKXINSALELLNEVGIEGLTTRKLAQKLGVEQPTLYWHVKNKRALLDAMAIEMLDRHATHYCPLEGESWQDFLRNNAKSMRCALLSHRDGAKVCLGTGFTEQQYETAENSLAFLCQQGFSLENALYAMQAVGIYTLGCVLLDQELQVAKEERETPTTDSMPPLVRQVLELKDHQGAEPAFLFGLELIICGLEKQLKCESGS

SEQ ID NO: 209 - protein, 208 aa, Artificial Sequence
  Sulfonylurea responsive repressor L7-1E01
  misc_feature (9)..(9): Xaa can be any naturally occurring amino acid
MGSRLDKSXPINSALELLNEVGIEGLTTRKLAQKLGVEQPTLYWHVKNKRALLDALAIEMLDRHATHYCPLEGESWQDFLRNNAKSMRCALLSHRDGAKVCLGTGFTEQQYESAENSMAFLCQQGFSLEHALYAMQAVGIFTLGCVLLDQELQVAKEERETPTTDSMPPLLRQALELKDHQGAEPAFLFGLELIICGLEKQLKCESGS

SEQ ID NO: 210 - protein, 208 aa, Artificial Sequence
  Sulfonylurea responsive repressor L7-1F01
MGSRLDKSKVINSALELLNEVGIEGLTTRKLAQKLGVEQPTLYWHVKNKRALLDAMAIEMLDRHATHICPLEGESWQDFLRNNAKSMRCALLSHRDGAKVCLGTGFTEQQYESAENSMAFLCQQGFSLENAMYAMQAVGIFTLGCVLLDQELQVAKEERETPTTDSMPPLVRQVLELKDHQGAEPAFLFGLELIICGLEKQLKCESGS

SEQ ID NO: 211 - protein, 208 aa, Artificial Sequence
  Sulfonylurea responsive repressor L7-1G01
MGSRLDKSKVINSALELLNEVGIEGLTTRKLAQKLGVEQPTLYWHVKNKRALLDAMAIEMLDRHATHVCPLEGESWQDFLRNNAKSMRCALLSHRDGAKVCLGTGFTEQQYETAENSMAFLCQQGFSLENAMYAMQAVGIFTLGCVLLDQELQVAKEERETPTTDSMPPLVRQALELKDHQGAEPAFLFGLELIICGLEKQLKCESGS

SEQ ID NO: 212 - protein, 208 aa, Artificial Sequence
  Sulfonylurea responsive repressor L7-1C02
MGSRLDKSKVINSALELLNEVGIEGLTTRKLAQKLGVEQPTLYWHVKNKRALLDAMAIEMLDRHATHYCPLEGESWQDFLRNNAKSMRCALLSHRDGAKVCLGTGFTEQMYETAENSMAFLCQQGFSLEHALYAMQAVGIYTVGCVLLDQELQVAKEERETPTTDSMPPLVRQGLELKDHQGAEPAFLFGLELIICGLEKQLKCESGS

SEQ ID NO: 213 - protein, 208 aa, Artificial Sequence
  Sulfonylurea responsive repressor L7-1D02
  misc_feature (110)..(110): Xaa can be any naturally occurring amino acid
MGSRLDKSKAINSALELLNEVGIEGLTTRKLAQKLGVEQPTLYWHVKNKRALLDAMAIEMLDRHATHYCPLEGESWQDFLRNNAKSMRCALLSHRDGAKVCLGTGFTEQXYEAAENSMAFLCQQGFSLENAMYAMQAVGIYTLGCVLLDQELQVAKEERETPTTDSMPPLVRQVLELKDHQGAEPAFLFGLELIICGLEKQLKCESGS

SEQ ID NO: 214 - protein, 208 aa, Artificial Sequence
  Sulfonylurea responsive repressor L7-1E02
  misc_feature (56)..(56): Xaa can be any naturally occurring amino acid
  misc_feature (110)..(110): Xaa can be any naturally occurring amino acid
  misc_feature (138)..(139): Xaa can be any naturally occurring amino acid
MGSRLDKSKVINSALELLNEVGIEGLTTRKLAQKLGVEQPTLYWHVKNKRALLDAXAIEMLDRHATHYCPLEGESWQDFLRNNAKSMRCALLSHRDGAKVCLGTGFTEQXYETAENSLAFLCQQGFSLENAMYAMQAXXIYTLGCVLLDQELQVAKEERETPTTDSMPPLVRQALELKDHQGAEPAFLFGLELIICGLEKQLKCESGS

SEQ ID NO: 215 - protein, 208 aa, Artificial Sequence
  Sulfonylurea responsive repressor L7-1F02
MGSRLDKSKVINSALELLNEVGIEGLTTRKLAQKLGVEQPTLYWHVKNKRALLDAMAIEMLDRHATHYGPLEGESWQDFLRNNAKSMRCALLSHRDGAKVCLGTGFTEQQYETAENSMAFLCQQGFSLENAMYAMQAVCIYTLGCVLLDQELQVAKEERETPTTDSMPPLVRQVLELKDHQGAEPAFLFGLELIICGLEKQLKCESGS

SEQ ID NO: 216 - protein, 208 aa, Artificial Sequence
  Sulfonylurea responsive repressor L7-1G02
  misc_feature (10)..(10): Xaa can be any naturally occurring amino acid
MGSRLDKSKXINSALELLNEVGIEGLTTRKLAQKLGVEQPTLYWHVKNKRALLDAMAIEMLDRHATHYCPLEGESWQDFLRNNAKSMRCALLSHRDGAKVCLGTGFTEKMYEGAENSMAFLCQQGFSLEHAMYAMQAAGIFTLGCVLLDQELQVAKEERETPTTDSMPPLVRQALELKDHQGAEPAFLFGLELIICGLEKQLKCESGS

SEQ ID NO: 217 - protein, 208 aa, Artificial Sequence
  Sulfonylurea responsive repressor L7-1H02
MGSRLDKSKVINSALELLNEVGIEGLTTRKLAQKLGVEQPTLYWHVKNKRALLDAMAIEMLDRHATHYCPLEGESWQDFLRNNAKSMRCALLSHRDGAKVCLGTGFTEQQYETAENSLAFLCQQGFSLEHAMYAMQAVGIFTLGCVLLDQELQVAKEERETPTTDSMPPLVRQALELKDHQGAEPAFLFGLELIICGLEKQLKCESGS

SEQ ID NO: 218 - protein, 208 aa, Artificial Sequence
  Sulfonylurea responsive repressor L7-1C03
MGSRLDKSKAINSALELLNEVGIEGLTTRKLAQKLGVEQPTLYWHVKNKRALLDAMAIEMLDRHATHVCPLEGESWQDFLRNNAKIMRCALLSHRDGAKVCLGTGFTEQQYETAENSLAFLCQQGFSLEHALYAMQAAGIFTLGCVLLDQELQVAKEERETPTTDSMPPLVRQALELNDHQGAEPAFLFGLELIICGLEKQLKCESGS

SEQ ID NO: 219 - protein, 208 aa, Artificial Sequence
  Sulfonylurea responsive repressor L7-1E03
MGSRLDKSKAINSALELLNEVGIEGLTTRKLAQKLGVEQPTLYWHVKNKRALLDALAIEMLDRHATHYCPLEGESWQDFLRNNAKSMRCALLSHRDGAKVCLGTGFTEQMYETAENSMAFLCQQGFSLENAMYAMQAAGIYTLGCVLLDQELQVAKEERETPTTDSMPPLVRQVLELKDHQGAEPAFLFGLELIICGLEKQLKCESGS

SEQ ID NO: 220 - protein, 208 aa, Artificial Sequence
  Sulfonylurea responsive repressor L7-1A04
MGSRLDKSKVINSALELLNEVGIEGLTTRKLAQKLGVEQPTLYWHVKNKRALLDAMAIEMLDRHATHYCPLEGKSWQDFLRNNAKSMRCALLSHRDGAKVCLGTGFTEQQYESAENSMAFLCQQGFSLEHAMYAMQAAGIFTLGCVLLDQELQVAKEERETPTTDSMPPLLRQALELKDHQGAEPAFLFGLELIICGLEKQLKCESGS

SEQ ID NO: 221 - protein, 208 aa, Artificial Sequence
  Sulfonylurea responsive repressor L7-1C04
  misc_feature (10)..(10): Xaa can be any naturally occurring amino acid
MGSRLDKSKXINSALELLNEVGIEGLTTRKLAQKLGVEQPTLYWHVKNKRALLDALAIEMLDRHATHYCPLEGESWQDFLRNNAKSMRCALLSHRDGAKVCLGTGFTEQMYESAENSLAFLCQQGFSLEHAMYAMQAAGIYTLGCVLLDQELQVAKEERETPTTDSMPPLVRQGLELKDHQGAEPAFLFGLELIICGLEKQLKCESGS

SEQ ID NO: 222 - protein, 208 aa, Artificial Sequence
  Sulfonylurea responsive repressor L7-1D04
MGSRLDKSKAINSALELLNEVGIEGLTTRKLAQKLGVEQPTLYWHVKNKRALLDAMAIEMLDRHATHYCPLEGESWQDFLRNNAKSMRCALLSHRDGAKVCLGTGFTEQQYEGAENSMAFLCQQGFSLENAMYAMQAVGIFTLGCVLLDQELQVAKEERETPTTDSMPPLVRQGLELKDHQGAEPAFLFGLELIICGLEKQLKCESGS

SEQ ID NO: 223 - protein, 208 aa, Artificial Sequence
  Sulfonylurea responsive repressor L7-1E04
  misc_feature (10)..(10): Xaa can be any naturally occurring amino acid
MGSRLDKSKXINSALELLNEVGIEGLTTRKLAQKLGVEQPTLYWHVKNKRALLDAMAIEMLDRHATHYCPLEGESWQDFLRNNAKSMRCALLSHRDGAKVCLGTGFTEQQYETAENSLAFLCQQGFSLEHALYAMQAVGIYTLGCVLLDQELQVAKEERETPTTDSMPPLARQALELKDHQGAEPAFLFGLELIICGLEKQLKCESGS

SEQ ID NO: 224 - protein, 208 aa, Artificial Sequence
  Sulfonylurea responsive repressor L7-1F04
  misc_feature (10)..(10): Xaa can be any naturally occurring amino acid
MGSRLDKSKXINSALELLNEVGIEGLTTRKLAQKLGVEQPTLYWHVKNKRALLDALAIEMLDRHATHYCPLEGESWQDFLRNNAKSMRCALLSHRDGAKVCLGTGFTEQHYETAENSMAFLCQQGFSLENALYAMQAVGIFTLGCVLLDQELQVAKEERETPTTDSMPPLVRQALELKDHQGAEPAFLFGLELIICGLEKQLKCESGS

SEQ ID NO: 225 - protein, 208 aa, Artificial Sequence
  Sulfonylurea responsive repressor L7-1G04
  misc_feature (10)..(10): Xaa can be any naturally occurring amino acid
MGSRLDKSKXINSALELLNEVGIEGLTTRKLAQKLGVEQPTLYWHVKNKRALLDAMAIEMLDRHATHYCPLEGESWQDFLRNNAKSMRCALLSHRDGAKVCLGTGFTEQQYESAENSMAFLCQQGFSLENAMYAMQAVGIYTLGCVLLDQELQVAKEERETPTTDSMPPLLRQVLELKDHQGAEPAFLFGLELIICGLEKQLKCESGS

SEQ ID NO: 226 - protein, 208 aa, Artificial Sequence
  Sulfonylurea responsive repressor L7-1H04
  misc_feature (10)..(10): Xaa can be any naturally occurring amino acid
MGSRLDKSKXINSALELLNEVGIEGLTTRKLAQKLGVEQPTLYWHVKNKRALLDALAIEMLDRHATHYCPLEGESWQDFLRNNAKSMRCALLSHRDGAKVCLGTGFTEKQYEAAENSLAFLCQQGFSLEHALYAMQAAGIYTLGCVLLDQELQVAKEERETPTTDSMPPLVRQALELKDHQGAEPAFLFGLELIICGLEKQLKCESGS

SEQ ID NO: 227 - protein, 208 aa, Artificial Sequence
  Sulfonylurea responsive repressor L7-1A05
MGSRLDKSKVINSALELLNEVGIEGLTTRKLAQKLGVEQPTLYWHVKNKRALLDAMAIEMLDRHATHYCPLEGESWQDFLRNNAKSMRCALLSHRDGAKVCLGTGFTEQHYETAENSMAFLCQQGFSLEHALYAMQAAGIYTLGCVLLDQELQVAKEERETPTTDSMPPLVRQALELKDHQGAEPAFLFGLELIICGLEKQLKCESGS

SEQ ID NO: 228 - protein, 208 aa, Artificial Sequence
  Sulfonylurea responsive repressor L7-1C05
  misc_feature (10)..(10): Xaa can be any naturally occurring amino acid
MGSRLDKSKXINSALELLNEVGIEGLTTRKLAQKLGVEQPTLYWHVKNKRALLDAMAIEMLDRHATHYCPLEGESWQDFLRNNAKSMRCALLSHRDGAKVCLGTGFTEQHYETAENSMAFLCQQGFSLENAMYAMQAVGIYTLGCVLLDQELQVAKEERETPTTDSMPPLVRQALELKDHQGAEPAFLFGLELIICGLEKQLKCESGS

SEQ ID NO: 229 - protein, 208 aa, Artificial Sequence
  Sulfonylurea responsive repressor L7-1E05
MGSRLDKSKVINSALELLNEVGIEGLTTRKLAQKLGVEQPTLYWHVKNKRALLDAMAIEMLDRHATHYCPLEGESWQDFLRNNAKSMRCALLSHRDGAKVCLGTGFTEQQYETAENSMAFLCKQGFSLENAMYAMQAVGIYTLGCVLLDQELQVAKEERETPTTDSMPPLVRQVLELKDHQGAEPAFLFGLELIICGLEKQLKCESGS

SEQ ID NO: 230 - protein, 208 aa, Artificial Sequence
  Sulfonylurea responsive repressor L7-1F05
  misc_feature (56)..(56): Xaa can be any naturally occurring amino acid
  misc_feature (113)..(113): Xaa can be any naturally occurring amino acid
  misc_feature (118)..(118): Xaa can be any naturally occurring amino acid
  misc_feature (174)..(174): Xaa can be any naturally occurring amino acid
MGSRLDKSKVINSALELLNEVGIEGLTTRKLAQKLGVEQPTLYWHVKNKRALLDAXAIEMLDRHATHYCPLEGESWQDFLRNNAKSMRCALLSHRDGAKVCLGTGFTEQHYEXAENSXAFLCQQGFSLEHALYAMQAVGIYTLGCVLLDQELQVAKEERETPTTDSMPPLVRQXLELKDHQGAEPAFLFGLELIICGLEKQLKCESGS

SEQ ID NO: 231 - protein, 208 aa, Artificial Sequence
  Sulfonylurea responsive repressor L7-1A06
MGSRLDKSKVINSALELLNEVGIEGLTTRKLAQKLGVEQPTLYWHVKNKRALLDALAIEMLDRHATHYCPLEGESWQDFLRNNAKSMRCALLSHRDGAKVCLGTGFTEQHYESAENSLAFLCQQGFSLENAMYAMQAVGIFTLGCVLLDQELQVAKEERETPTTDSMPPLVRQVLELKDHQGAEPAFLFGLELIICGLEKQLKCESGS

SEQ ID NO: 232 - protein, 208 aa, Artificial Sequence
  Sulfonylurea responsive repressor L7-1B06
MGSRLDKSKAINSALELLNEVGIEGLTTRKLAQKLGVEQPTLYWHVKNKRALLDAMAIEMLDRHATHYCPLEGESWQDFLRNNAKSMRCALLSHRDGAKVCLGTGFTEQQYETAENSLAFLCQQGFSLENALYAMQAVGIYTLGCVLLDQELQVAKEERETPTTDSMPPLVRQVLELKDHQGAEPAFLFGLELIICGLEKQLKCESGS

SEQ ID NO: 233 - protein, 208 aa, Artificial Sequence
  Sulfonylurea responsive repressor L7-1D06
MGSRLDKSKVINSALELLNEVGIEGLTTRKLAQKLGVEQPTLYWHVKNKRALLDAMAIEMLDRHATHYCPLEGESWQDFLRNNAKSMRCALLSHRDGAKVCLGTGFTEQQYEAAENSMAFLCQQDFSLEHAMYAMQAVGIYTLGCVLLDQELQVAKEERETPTTDSMPPLVRQGLELKDHQGAEPAFLFGLELIICGLEKQLKCESGS

SEQ ID NO: 234 - protein, 208 aa, Artificial Sequence
  Sulfonylurea responsive repressor L7-1E06
  misc_feature (113)..(113): Xaa can be any naturally occurring amino acid
MGSRLDKSKVINSALELLNEVGIEGLTTRKLAQKLGVEQPTLYWHVKNKRALLDAMAIEMLDRHATHYCPLEGKSWQDFLRNNAKSMRCALLSHRDGAKVCLGTGFTEQHYEXAENSMAFLCQQGFSLEHAMYAMQAAGIFTLGCVLLDQELQVAKEERETPTTDSMPPLLRQALELKDHQGAEPAFLFGLELIICGLEKQLKCESGS

SEQ ID NO: 235 - protein, 208 aa, Artificial Sequence
  Sulfonylurea responsive repressor L7-1F06
MGSRLDKSKVINSALELLNEVGIEGLTTRKLAQKLGVEQPTLYWHVKNKRALLDAMAIEMLDRHATHYCPLEGESWQDFLRNNAKSMRCALLSHRDGAKVCLGTGFTEQQYETAENSLAFLCQQGFSLEHAMYAMQAAGIYTLGCVLLDQELQVAKEERETPTTDSMPPLVRQALELKDHQGAEPAFLFGLELIICGLEKQLKCESGS

SEQ ID NO: 236 - protein, 208 aa, Artificial Sequence
  Sulfonylurea responsive repressor L7-1G06
  misc_feature (10)..(10): Xaa can be any naturally occurring amino acid
MGSRLDKSKXINSALELLNEVGIEGLTTRKLAQKLGVEQPTLYWHVKNKRALLDAMAIEMLDRHATHYCPLEGESWQDFLRNNAKSMRCALLSHRDGAKVCLGTGFTEQQYETAENSMAFLCQQGFSLENALYAMQAVGIYTLGCVLLDQELQVAKEERETPTTDSMPPLVRQALELKDHQGAEPAFLFGLELIICGLEKQLKCESGS

SEQ ID NO: 237 - protein, 208 aa, Artificial Sequence
  Sulfonylurea responsive repressor L7-1H06
MGSRLDKSKAINSALELLNEVGIEGLTTRKLAQKLGVEQPTLYWHVKNKRALLDALAIEMLDRHATHYCPLEGESWQDFLRNNAKSMRCALLSHRDGAKVCLGTGFTEKHYETAENSMAFLCQQGFSLEHAMYAMQAVGIYTLGCVLLDQELQVAKEERETPTTDSMPPLVRQVLELKDHQGAEPAFLFGLELIICGLEKQLKCESGS

SEQ ID NO: 238 - protein, 208 aa, Artificial Sequence
  Sulfonylurea responsive repressor L7-1A07
  misc_feature (10)..(10): Xaa can be any naturally occurring amino acid
MGSRLDKSKXINSALELLNEVGIEGLTTRKLAQKLGVEQPTLYWHVKNKRALLDALAIEMLDRHATHYCPLEGESWQDFLRNNAKSMRCALLSHRDGAKVCLGTGFTEKQYEAAENSMAFLCQQGFSLEHAMYAMQAAGIYTLGCVLLDQELQVAKEERETPTTDSMPPLVRQVLELKDHQGAEPAFLFGLELIICGLEKQLKCESGS

SEQ ID NO: 239 - protein, 208 aa, Artificial Sequence
  Sulfonylurea responsive repressor L7-1B07
  misc_feature (10)..(10): Xaa can be any naturally occurring amino acid
MGSRLDKSKXINSALELLNEVGIEGLTTRKLAQKLGVEQPTLYWHVKNKRALLDAMAIEMLDRHATHYCPLEGESWQDFLRNNAKSMRCALLSHRDGAKVCLGTGFTEQQYETAENSMAFLCQQGFSLENAMYAMQAACIYTLGCVLLDQELQVAKEERETPTTDSMPPLVRQVLELKDHQGAEPAFLFGLELIICGLEKQLKCESGS

SEQ ID NO: 240 - protein, 208 aa, Artificial Sequence
  Sulfonylurea responsive repressor L7-1C07
  misc_feature (10)..(10): Xaa can be any naturally occurring amino acid
MGSRLDKSKXINSALELLNEVGIEGLTTRKLAQKLGVEQPTLYWHVKNKRALLDAMAIEMLDRHATHYCPLEGESWQDFLRNNAKSMRCALLSHRDGAKVCLGTGFTEQQYETAENSLAFLCQQGFSLEHALYAMQAAGIFTLGCVLLDQELQVAKEERETPTTDSMPPLVRQALELKDHQGAEPAFLFGLELIICGLEKQLKCESGS

SEQ ID NO: 241 - protein, 208 aa, Artificial Sequence
  Sulfonylurea responsive repressor L7-1D07
  misc_feature (10)..(10): Xaa can be any naturally occurring amino acid
MGSRLDKSKXINSALELLNEVGIEGLTTRKLAQKLGVEQPTLYWHVKNKRALLDAMAIEMLDRHATHVCPLEGESWQDFLRNNAKSMRCALLSHRDGAKVCLGTGFTEQQYEGAENSMAFLCQQGFSLEHAMYAMQAVGIYTLGCVLLDQELQVAKEERETPTTDSMPPLVRQALELKDHQGAEPAFLFGLELIICGLEKQLKCGSGS

SEQ ID NO: 242 - protein, 208 aa, Artificial Sequence
  Sulfonylurea responsive repressor L7-1E07
MGSRLDKSKVINSALELLNEVGIEGLTTRKLAQKLGVEQPTLYWHVKNKRALLDALAIEMLDRHATHICPLEGESWQDFLRNNAKSMRCALLSHRDGAKVCLGTGFTEQMYETAENSMAFLCQQGFSLENAMYAMQAAGIFTLGCVLLDQELQVAKEERETPTTDSMPPLVRQVLELKDHQGAEPAFLFGLELIICGLEKQLKCESGS

SEQ ID NO: 243 - protein, 208 aa, Artificial Sequence
  Sulfonylurea responsive repressor L7-1F07
  misc_feature (10)..(10): Xaa can be any naturally occurring amino acid
MGSRLDKSKXINSALELLNEVGIEGLTTRKLAQKLGVEQPTLYWHVKNKRALLDALAIEMLDRHATHYCPLEGESWQDFLRNNAKSMRCALLSHRDGAKVCLGTGFTEQMYESAENSLAFLCQQGFSLEHAMYAMQAAGIFTLGCVLLDQELQVAKEERETPTTDSMPPLVRQVLELKDHQGAEPAFLFGLELIICGLEKQLKCESGS

SEQ ID NO: 244 - protein, 208 aa, Artificial Sequence
  Sulfonylurea responsive repressor L7-1G07
  misc_feature (199)..(199): Xaa can be any naturally occurring amino acid
MGSRLDKSKVINSALELLNEVGIEGLTTRKLAQKLGVEQPTLYWHVKNKRALLDAMAIEMLDRHATHYCPLEGESWQDFLRNNAKSMRCALLSHRDGAKVCLGTGFTEQHYESAENSMAFLCQQGFSLEHAMYAMQAAGIYTLGCVLLDQELQVAKEERQTPTTDSMPPLVRQALELKDHQGAEPAFLFGLELIICGLXKQLKCESGS

SEQ ID NO: 245 - protein, 208 aa, Artificial Sequence
  Sulfonylurea responsive repressor L7-1A08
  misc_feature (10)..(10): Xaa can be any naturally occurring amino acid
MGSRLDKSKXINSALELLNEVGIEGLTTRKLAQKLGVEQPTLYWHVKNKRALLDAMAIEMLDRHATHLCPLEGESWQDFLRNNAKSMRCALLSHRDGAKVCLGTGFTEQQYETAENSMAFLCQQGFSLEHAMYAMQAVGIYTLGCVLLDQELQVAKEERETPTTDSMPPLLRQALELKDHQGAEPAFLFGLELIICGLEKQLKCESGS

SEQ ID NO: 246 - protein, 208 aa, Artificial Sequence
  Sulfonylurea responsive repressor L7-1C08
  misc_feature (56)..(56): Xaa can be any naturally occurring amino acid
  misc_feature (110)..(110): Xaa can be any naturally occurring amino acid
MGSRLDKSKVINSALELLNEVGIEGLTTRKLAQKLGVEQPTLYWHVKNKRALLDAXAIEMLDRHATHYCPLEGESWQDFLRNNAKSMRCALLSHRDGAKVCLGTGFTEQXYEAAENSMAFLCQQGFSLEHAMYAMQAAGIYTLGCVLLDQELQVAKEERETPTTDSMPPLVRQVLELKDHQGAEPAFLFGLELIICGLEKQLKCESGS

SEQ ID NO: 247 - protein, 208 aa, Artificial Sequence
  Sulfonylurea responsive repressor L7-1D08
  misc_feature (171)..(171): Xaa can be any naturally occurring amino acid
MGSRLDKSKVINSALELLNEVGIEGLTTRKLAQKLGVEQPTLYWHVKNKRALLDAMAIEMLDRHATHYCPLEGESWQDFLRNNAKSMRCALLSHRDGAKVCLGTGFTEQQYETAENSMAFLCQQGFSLEHALYAMQAAGIYTLGCVLLDQELQVAKEERETPTTDSMPPLXRQVLELKDHQGAEPAFLFGLELIICGLEKQLKCESGS

SEQ ID NO: 248 - protein, 208 aa, Artificial Sequence
  Sulfonylurea responsive repressor L7-1E08
  misc_feature (10)..(10): Xaa can be any naturally occurring amino acid
MGSRLDKSKXINSALELLNEVGIEGLTTRKLAQKLGVEQPTLYWHVKNKRALLDAMAIEMLDRHATHYCPLEGESWQDFLRNNAKSMRCALLSHRDGAKVCLGTGFTEQQYETAENSLAFLCQQGFSLEHAMYAMQAVGIFTLGCVLLDQELQVAKEERETPTTDSMPPLVRQVLELKDHQGAEPAFLFGLELIICGLEKQLKCESGS

SEQ ID NO: 249 - protein, 208 aa, Artificial Sequence
  Sulfonylurea responsive repressor L7-1F08
MGSRLDKSKVINSALELLNEVGIEGLTTRKLAQKLGVEQPTLYWHVKNKRALLDAMAIEMLDRHATHYCPLEGESWQDFLRNNAKSMRCALLSHRDGAKVCLGTGFTEQQYETAENSLAFLCQQGFSLENALYAMQAVGIYTLGCVLLDQELQVAKEERETPTTDSMPPLVRQALELKDHQGAEPAFLFGLELIICGLEKQLKCESGS

SEQ ID NO: 250 - protein, 208 aa, Artificial Sequence
  Sulfonylurea responsive repressor L7-1G08
MGSRLDKSKVINSALELLNEVGIEGLTTRKLAQKLGVEQPTLYWHVKNKRALLDAMAIEMLDRHATHYCPLEGESWQDFLRNNAKSMRCALLSHRDGAKVCLGTGFTEQHYETAENSLAFLCQQGFSLEHAMYAMQAVGIYTLGCVLLDQELQVAKEERETPTTDSMPPLVRQALELKDHQGAEPAFLFGLELIICGLEKQLKCESGS

SEQ ID NO: 251 - protein, 208 aa, Artificial Sequence
  Sulfonylurea responsive repressor L7-1A09
  misc_feature (10)..(10): Xaa can be any naturally occurring amino acid
MGSRLDKSKXINSALELLNEVGIEGLTTRKLAQKLGVEQPTLYWHVKNKRALLDAMAIEMLDRHATHYCPLEEESWQDFLRNNAKSMRCALLSHRDGAKVCLGTGFTEQQYEAAENSMAFLCQQGFSLEHALYAMQAAGIYTLGCVLLDQELQVAKEERETPTTDSMPPLVRQALELKDHQGAEPAFLFGLELIICGLEKQLKCESGS

SEQ ID NO: 252 - protein, 208 aa, Artificial Sequence
  Sulfonylurea responsive repressor L7-1B09
MGSRLDKSKVINSALELLNEVGIEGLTTRKLAQKLGVEQPTLYWHVKNKRALLDAMAIEMLDRHATHYCPLEGESWQDFLRNNAKSMRCALLSHRDGAKVCLGTGFTEQQYETAENSLAFLCQQGFSLENAMYAMQAAGIYTLGCVLLDQELQVAKEERETPTTDSMPPLVRQGLELKDHQGAEPAFLFGLELIICGLEKQLKCESGS

SEQ ID NO: 253 - protein, 208 aa, Artificial Sequence
  Sulfonylurea responsive repressor L7-1C09
MGSRLDKSKAINSALELLNEVGIEGLTTRKLAQKLGVEQPTLYWHVKNKRALLDALAIEMLDRHATHYCPLEGESWQDFLRNNAKSMRCALLSHRDGAKVCLGTGFTEQHYETAENSLAFLCQQGFSLENAMYAMQAVGIFTLGCVLLDQELQVAKEERETPTTDSMPPLVRQVLELKDHQGAEPAFLFGLELIICGLEKQLKCESGS

SEQ ID NO: 254 - protein, 208 aa, Artificial Sequence
  Sulfonylurea responsive repressor L7-1D09
MGSRLDKSKVINSALELLNEVGIEGLTTRKLAQKLGVEQPTLYWHVKNKRALLDAMAIEMLDRHATHYCPLEGESWQDFLRNNAKSMRCALLSHRDGAKVCLGTGFTEQQYESAENSLAFLCQQGFSLENAMYAMQAAGIYTLGCVLLDQELQVAKEERETPTTDSMPPLLRQALELKDHQGAEPAFLFGLELIICGLEKQLKCESGS

SEQ ID NO: 255 - protein, 208 aa, Artificial Sequence
  Sulfonylurea responsive repressor L7-1E09
  misc_feature (10)..(10): Xaa can be any naturally occurring amino acid
MGSRLDKSKXINSALELLNEVGIEGLTTRKLAQKLGVEQPTLYWHVKNKRALLDAMAIEMLDRHATHYCPLEGESWQDFLRNNAKSMRCALLSQRDGAKVCLGTGFTEQQYEGAENSLAFLCQQGFSLEHALYAMQAAGIFTLGCVLLDQELQVAKEERETPTTDSMPPLVRQALELKDHQGAEPAFLFGLELIICGLEKQLKCESGS

SEQ ID NO: 256 - protein, 208 aa, Artificial Sequence
  Sulfonylurea responsive repressor L7-1G09
MGSRLDKSKVINSALELLNEVGIEGLTTRKLAQKLGVEQPTLYWHVKNKRALLDAMAIEMLDRHATHYCPLEGESWQDFLRNNAKSMRCALLSHRDGAKVCLGTGFTEQQYETAENSMAFLCQQGFSLENALYAMQAAGIYTLGCVLLDQELQVAKEERETPTTDSMPPLVRQGLELKDHQGAEPAFLFGLELIICGLEKQLKCESGS

SEQ ID NO: 257 - protein, 208 aa, Artificial Sequence
  Sulfonylurea responsive repressor L7-1A10
MGSRLDKSKVINSALELLNEVGIEGLTTRKLAQKLGVEQPTLYWHVKNKRALLDALAIEMLDRHATHYCPLEGESWQDFLRNNAKSMRCALLSHRDGAKVCLGTGFTEQMYESAENSMAFLCQQGFSLENAMYAMQAAGIYTLGCVLLDQELQVAKEERETPTTDSMPPLVRQGLELKDHQGAEPAFLFGLELIICGLEKQLKCESGS

SEQ ID NO: 258 - protein, 208 aa, Artificial Sequence
  Sulfonylurea responsive repressor L7-1B10
MGSRLDKSKVINSALELLNEVGIEGLTTRKLAQKLGVEQPTLYWHVKNKRALLDAMAIEMLDRHATHYCPLEGESWQDFLRNNAKSMRCALLSHRDGAKVCLGTGFTEQQYEGAENSMAFLCQQGFSLENAMYAMQAVGIFTLGCVLLDQELQVAKEERETPTTDSMPPLVRQALELKDHQGAEPAFLFGLELIICGLEKQLKCESGS

SEQ ID NO: 259 - protein, 208 aa, Artificial Sequence
  Sulfonylurea responsive repressor L7-1C10
  misc_feature (68)..(68): Xaa can be any naturally occurring amino acid
  misc_feature (110)..(110): Xaa can be any naturally occurring amino acid
  misc_feature (113)..(113): Xaa can be any naturally occurring amino acid
  misc_feature (132)..(132): Xaa can be any naturally occurring amino acid
MGSRLDKSKVINSALELLNEVGIEGLTTRKLAQKLGVEQPTLYWHVKNKRALLDALAIEMLDRHATHXCPLEGESWQDFLRNNAKSMRCALLSHRDGAKVCLGTGFTEQXYEXAENSMAFLCQQGFSLEHAXYAMQAAGIFTLGCVLLDQELQVAKEERETPTTDSMPPLLRQALELKDHQGAEPAFLFGLELIICGLEKQLKCESGS

SEQ ID NO: 260 - protein, 208 aa, Artificial Sequence
  Sulfonylurea responsive repressor L7-1D10
MGSRLDKSKVINSALELLNEVGIEGLTTRKLAQKLGVEQPTLYWHVKNKRALLDAMAIEMLDRHATHICPLEGESWQDFLRNNAKSMRCALLSHRDGAKVCLGTGFTEQQYETAENSLAFLCQQGFSLENALYAMQAAGIFTLGCVLLDQELQVAKEERETPTTDSMPPLVRQVLELKDHQGAEPAFLFGLELIICGLEKQLKCESGS

SEQ ID NO: 261 - protein, 208 aa, Artificial Sequence
  Sulfonylurea responsive repressor L7-1F10
  misc_feature (68)..(68): Xaa can be any naturally occurring amino acid
  misc_feature (113)..(113): Xaa can be any naturally occurring amino acid
  misc_feature (130)..(130): Xaa can be any naturally occurring amino acid
  misc_feature (139)..(139): Xaa can be any naturally occurring amino acid
  misc_feature (171)..(171): Xaa can be any naturally occurring amino acid
  misc_feature (174)..(174): Xaa can be any naturally occurring amino acid
MGSRLDKSKVINSALELLNEVGIEGLTTRKLAQKLGVEQPTLYWHVKNKRALLDALAIEMLDRHATHXCPLEGESWQDFLRNNAKSMRCALLSHRDGAKVCLGTGFTEQLYEXAENSLAFLCQQGFSLEXALYAMQAAXIYTLGCVLLDQELQVAKEERETPTTDSMPPLXRQXLELKDHQGAEPAFLFGLELIICGLEKQLKCESGS

SEQ ID NO: 262 - protein, 208 aa, Artificial Sequence
  Sulfonylurea responsive repressor L7-1A11
MGSRLDKSKVINSALELLNEVGIEGLTTRKLAQKLGVEQPTLYWHVKNKRALLDALAIEMLDRHATHYCPLEGESWQDFLRNNAKSMRCALLSHRDGAKVCLGTGFTEKQYESAENSLAFLCQQGFSLEHAMYAMQAAGIYTLGCVLLDQELQVAKEERETPTTDSMPPLVRQALELKDHQGAEPAFLFGLELIICGLEKQLKCESGS

SEQ ID NO: 263 - protein, 208 aa, Artificial Sequence
  Sulfonylurea responsive repressor L7-1B11
  misc_feature (171)..(171): Xaa can be any naturally occurring amino acid
MGSRLDKSKVINSALELLNEVGIEGLTTRKLAQKLGVEQPTLYWHVKNKRALLDAMAIEMLDRHATHYCPLEGESWQDFLRNNAKSMRCALLSHRDGAKVCLGTGFTEQQYESAENSMAFLCQQGFSLEHAMYAMQAAGIYTLGCVLLDQELQVAKEERETPTTDSMPPLXRQVLELKDHQGAEPAFLFGLELIICGLEKQLKCESGS

SEQ ID NO: 264 - protein, 208 aa, Artificial Sequence
  Sulfonylurea responsive repressor L7-1C11
  misc_feature (56)..(56): Xaa can be any naturally occurring amino acid
  misc_feature (118)..(118): Xaa can be any naturally occurring amino acid
  misc_feature (139)..(139): Xaa can be any naturally occurring amino acid
MGSRLDKSKVINSALELLNEVGIEGLTTRKLAQKLGVEQPTLYWHVKNKRALLDAXAIEMLDRHATHYCPLEGESWQDFLRNNAKSMRCALLSHRDGAKVCLGTGFTEQMYETAENSXAFLCQQGFSLEHAMYAMQAAXIYTLGCVLLDQELQVAKEERETPTTDSMPPLARQGLELKDHQGAEPAFLFGLELIICGLEKQLKCESGS

SEQ ID NO: 265 - protein, 208 aa, Artificial Sequence
  Sulfonylurea responsive repressor L7-1E11
  misc_feature (110)..(110): Xaa can be any naturally occurring amino acid
MGSRLDKSKVINSALELLNEVGIEGLTTRKLAQKLGVEQPTLYWHVKNKRALLDAMAIEMLDRHATHYCPLEGESWQDFLRNNAKSMRCALLSHRDGAKVCLGTGFTEQXYEAAENSMAFLCQQGFSLEHAMYAMQAAGIFTLGCVLLDQELQVAKEERETPTTDSMPPLVRQALELKDHQGAEPAFLFGLELIICGLEKQLKCESGS

SEQ ID NO: 266 - protein, 208 aa, Artificial Sequence
  Sulfonylurea responsive repressor L7-1A12
  misc_feature (68)..(68): Xaa can be any naturally occurring amino acid
MGSRLDKSKVINSALELLNEVGIEGLTTRKLAQKLGVEQPTLYWHVKNKRALLDAMAIEMLDRHATHXCPLEGESWQDFLRNNAKSMRCALLSHRDGAKVCLGTGFTEQQYEGAENSLAFLCQQGFSLEHAMYAMQAVGIYTLGCVLLDQELQVAKEERETPTTDSMPPLVRQGLELKDHQGAEPAFLFGLELIICGLEKQLKCESGS

SEQ ID NO: 267 - protein, 208 aa, Artificial Sequence
  Sulfonylurea responsive repressor L7-1C12
  misc_feature (110)..(110): Xaa can be any naturally occurring amino acid
  misc_feature (113)..(113): Xaa can be any naturally occurring amino acid
  misc_feature (141)..(141): Xaa can be any naturally occurring amino acid
  misc_feature (199)..(199): Xaa can be any naturally occurring amino acid
MGSRLDKSKVINSALELLNEVGIEGLTTRKLAQKLGVEQPTLYWHVKNKRALLDAMAIEMLDRHATHYCPLEGESWQDFLRNNAKSMRCALLSHRDGAKVCLGTGFTEQXYEXAENSLAFLCQQGFSLEHAMYAMQAAGIXTLGCVLLDQELQVAKEERETPTTDSMPPLARQGLELKDHQGAEPAFLFGLELIICGLXKQLKCESGS

SEQ ID NO: 268 - protein, 208 aa, Artificial Sequence
  Sulfonylurea responsive repressor L7-1F12
  misc_feature (154)..(154): Xaa can be any naturally occurring amino acid
  misc_feature (195)..(195): Xaa can be any naturally occurring amino acid
  misc_feature (199)..(199): Xaa can be any naturally occurring amino acid
MGSRLDKSKVINSALELLNEVGIEGLTTRKLAQKLGVEQPTLYWHVKNKRALLDAMAIEMLDRHATHYCPLEGESWQDFLRNNAKSMRCALLSHRDGAKVCLGTGFTEQQYESAENSMAFLCQQGFSLEHAMYAMQAAGIYTLGCVLLDQELQXAKEERETPTTDSMPPLLRQVLELNDHQGAEPAFLFGLELIXCGLXKQLKCESGS

SEQ ID NO: 269 - protein, 208 aa, Artificial Sequence
  Sulfonylurea responsive repressor L7-1G12
  misc_feature (93)..(93): Xaa can be any naturally occurring amino acid
  misc_feature (154)..(154): Xaa can be any naturally occurring amino acid
  misc_feature (161)..(161): Xaa can be any naturally occurring amino acid
  misc_feature (166)..(166): Xaa can be any naturally occurring amino acid
  misc_feature (173)..(173): Xaa can be any naturally occurring amino acid
  misc_feature (186)..(186): Xaa can be any naturally occurring amino acid
  misc_feature (195)..(195): Xaa can be any naturally occurring amino acid
  misc_feature (200)..(201): Xaa can be any naturally occurring amino acid
MGSRLDKSKVINSALELLNEVGIEGLTTRKLAQKLGVEQPTLYWHVKNKRALLDAMAIEMLDRHATHYCPLEGESWQDFLRNNAKSMRCALLXHRDGAKVCLGTGFTEQQYEGAENSLAFLCQQGFSLEHAMYAMQAAGIYTLGCVLLDQELQXAKEEREXPTTDXMPPLARXGLELKDHQGPEPXFLFGLELIXCGLEXXLKCESGS

SEQ ID NO: 270 - protein, 208 aa, Artificial Sequence
  Sulfonylurea responsive repressor L7-2A01
MGSRLDKSKVINSALELLNEVGIEGLTTRKLAQKLGVEQPTLYWHVKNKRALLDAMAIEMLDRHATHVCPLEGESWQDFLRNNAKSMRCALLSHRDGAKVCLGTGFTEQQYEGAENSMAFLCQQGFSLEHAMYAMQAVGIYTLGCVLLDQELQVAKEERETPTTDSMPPLVRQALELKDHQGAEPAFLFGLELIICGLEKQLKCGSGS

SEQ ID NO: 271 - protein, 208 aa, Artificial Sequence
  Sulfonylurea responsive repressor L7-2B01
  misc_feature (56)..(56): Xaa can be any naturally occurring amino acid
  misc_feature (68)..(68): Xaa can be any naturally occurring amino acid
  misc_feature (109)..(110): Xaa can be any naturally occurring amino acid
  misc_feature (118)..(118): Xaa can be any naturally occurring amino acid
  misc_feature (130)..(130): Xaa can be any naturally occurring amino acid
  misc_feature (139)..(139): Xaa can be any naturally occurring amino acid
  misc_feature (141)..(141): Xaa can be any naturally occurring amino acid
MGSRLDKSKVINSALELLNEVGIEGLTTRKLAQKLGVEQPTLYWHVKNKRALLDAXAIEMLDRHATHXCPLEGESWQDFLRNNAKSMRCALLSHRDGAKVCLGTGFTEXXYEGAENSXAFLCQQGFSLEXAMYAMQAAXIXTLGCVLLDQELQVAKEERETPTTDSMPPLARQVLELKDHQGAEPAFLFGLELIICGLEKQLKCESGS

SEQ ID NO: 272 - protein, 208 aa, Artificial Sequence
  Sulfonylurea responsive repressor L7-2D01
  misc_feature (109)..(110): Xaa can be any naturally occurring amino acid
  misc_feature (132)..(132): Xaa can be any naturally occurring amino acid
  misc_feature (138)..(138): Xaa can be any naturally occurring amino acid
  misc_feature (171)..(171): Xaa can be any naturally occurring amino acid
MGSRLDKSKVINSALELLNEVGIEGLTTRKLAQKLGVEQPTLYWHVKNKRALLDAMAIEMLDRHATHYCPLEGESWQDFLRNNAKSMRCALLSHRDGAKVCLGTGFTEXXYESAENSMAFLCQQGFSLEHAXYAMQAXGIYTLGCVLLDQELQVAKEERETPTTDSMPPLXRQALELKDHQGAEPAFLFGLELIICGLEKQLKCESGS

SEQ ID NO: 273 - protein, 208 aa, Artificial Sequence
  Sulfonylurea responsive repressor L7-2E01
MGSRLDKSKVINSALELLNEVGIEGLTTRKLAQKLGVEQPTLYWHVKNKRALLDALAIEMLDRHATHYCPLEGESWQDFLRNNAKSMRCALLSHRDGAKVCLGTGFTEKQYETAENSMAFLCQQGFSLENALYAMQAVGIYTLGCVLLDQELQVAKEERETPTTDSMPPLVRQALELKDHQGAEPAFLFGLELIICGLEKQLKCESGS

SEQ ID NO: 274 - protein, 208 aa, Artificial Sequence
  Sulfonylurea responsive repressor L7-2F01
MGSRLDKSKVINSALELLNEVGIEGLTTRKLAQKLGVEQPTLYWHVKNKRALLDALAIEMLDRHATHYCPLEGESWQDFLRNNAKSMRCALLSHRDGAKVCLGTGFTEQMYETAENSLAFLCQQGFSLEHAMYAMQAAGIFTLGCVLLDQELQVAKEERETPTTDSMPPLVRQVLELKDHQGAEPAFLFGLELIICGLEKQLKCESGS

SEQ ID NO: 275 - protein, 208 aa, Artificial Sequence
  Sulfonylurea responsive repressor L7-2G01
  misc_feature (109)..(109): Xaa can be any naturally occurring amino acid
MGSRLDKSKVINSALELLNEVGIEGLTTRKLAQKLGVEQPTLYWHVKNKRALLDAMAIEMLDRHATHYCPLEGESWQDFLRNNAKSMRCALLSHRDGAKVCLGTGFTEXLYESAENSLAFLCQQGFSLEHAMYAMQAVGIYTLGCVLLDQELQVAKEERETPTTDSMPPLVRQVLELKDHQGAEPAFLFGLELIICGLEKQLKCESGS

SEQ ID NO: 276 - protein, 208 aa, Artificial Sequence
  Sulfonylurea responsive repressor L7-2H01
MGSRLDKSKVINSALELLNEVGIEGLTTRKLAQKLGVEQPTLYWHVKNKRALLDALAIEMLDRHATHYCPLEGESWQDFLRNNAKSMRCALLSHRDGAKVCLGTGFTEQMYETAENSMAFLCQQGFSLEHALYAMQAAGIFTLGCVLLDQELQVAKEERETPTTDSMPPLVRQALELKDHQGAEPAFLFGLELIICGLEKQLKCESGS

SEQ ID NO: 277 - protein, 208 aa, Artificial Sequence
  Sulfonylurea responsive repressor L7-2B02
MGSRLDKSKVINSALELLNEVGIEGLTTRKLAQKLGVEQPTLYWHVKNKRALLDAMAIEMLDRHATHYCPLEGESWQDFLRNNAKSMRCALLSHRDGAKVCLGTGFTEQMYESAENSLAFLCQQGFSLENALYAMQAVGIYTLGCVLLDQELQVAKEERETPTTDSMPPLVRQVLELKDHQGAEPAFLFGLELIICGLEKQLKCESGS

SEQ ID NO: 278 - protein, 208 aa, Artificial Sequence
  Sulfonylurea responsive repressor L7-2D02
MGSRLDKSKVINSALELLNEVGIEGLTTRKLAQKLGVEQPTLYWHVKNKRALLDAMAIEMLDRHATHFCPLEGESWQDFLRNNAKSMRCTLLSHRDGAKVCLGTGFTEQQYESAENSLAFLCQQGFSLENAMYAMQAVGIYTLGCVLLDQELQVAKEERETPTTDSMPPLVRQALELKDHQGAEPAFLFGLELIICGLEKQLKCESGS

SEQ ID NO: 279 - protein, 208 aa, Artificial Sequence
  Sulfonylurea responsive repressor L7-2E02
MGSRLDKSKVINSALELLNEVGIEGLTTRKLAQKLGVEQPTLYWHVKNKRALLDALAIEMLDRHATHICPLEGESWQDFLRNNAKSMRCALLSHRDGAKVCLGTGFTEQMYEAAENSMAFLCQQGFSLENAMYAMQAAGIYTLGCVLLDQELQVAKEERETPTTDSMPPLVRQALELKDHQGAEPAFLFGLELIICGLEKQLKCESGS

SEQ ID NO: 280 - protein, 208 aa, Artificial Sequence
  Sulfonylurea responsive repressor L7-2F02
MGSRLDKSKVINSALELLNEVGIEGLTTRKLAQKLGVEQPTLYWHVKNKRALLDAMAIEMLDRHATHYCPLEGESWQDFLRNNAKSMRCALLSHRDGAKVCLGTGFTEQHYETAENSLAFLCQQGFSLENAMYAMQAAGIYTLGCVLLDQELQVAKEERETPTTDSMPPLVRQVLELKDHQGAEPAFLFGLELIICGLEKQLKCESGS

SEQ ID NO: 281 - protein, 208 aa, Artificial Sequence
  Sulfonylurea responsive repressor L7-2G02
MGSRLDKSKVINSALELLNEVGIEGLTTRKLAQKLGVEQPTLYWHVKNKRALLDAMAIEMLDRHATHLCPLEGESWQDFLRNNAKSMRCALLSHRDGAKVCLGTGFTEQQYETAENSMAFLCQQGFSLEHAMYAMQAAGIYTLGCVLLDQELQVAKEERETPTTDSMPPLVRQGLELKDHQGAEPAFLFGLELIICGLEKQLKCESGS

SEQ ID NO: 282 - protein, 208 aa, Artificial Sequence
  Sulfonylurea responsive repressor L7-2H02
MGSRLDKSKVINSALELLNEVGIEGLTTRKLAQKLGVEQPTLYWHVKNKRALLDALAIEMLDRHATHFCPLEGESWQDFLRNNAKSMRCALLSHRDGAKVCLGTGFTEQMYEAAENSMAFLCQQGFSLEHAMYAMQAVCIYTLGCVLLDQELQVAKEERETPTTDSMPPLARQGLELKDHQGAEPAFLFGLELIICGLEKQLKCESGS

SEQ ID NO: 283 - protein, 208 aa, Artificial Sequence
  Sulfonylurea responsive repressor L7-2D03
MGSRLDKSKVINSALELLNEVGIEGLTTRKLAQKLGVEQPTLYWHVKNKRALLDALAIEMLDRHATHYCPLEGESWQDFLRNNAKSMRCALLSHRDGAKVCLGTGFTEQHYETAENSLAFLCQQGFSLENAMYAMQAVGIFTLGCVLLDQELQVAKEERETPTTDSMPPLVRQVLELKDHQGAEPAFLFGLELIICGLEKQLKCESGS

SEQ ID NO: 284 - protein, 208 aa, Artificial Sequence
  Sulfonylurea responsive repressor L7-2E03
MGSRLDKSKVINSALELLNEVGIEGLTTRKLAQKLGVEQPTLYWHVKNKRALLDAMAIEMLDRHATHYCPLEGESWQDFLRNNAKSMRCALLSHRDGAKVCLGTGFTEQQYESAENSLAFLCQQGFSLENAMYAMQAAGIYTLGCVLLDQELQVAKEERETPTTDSMPPLVRQALELKDHQGAEPAFLFGLELIICGLEKQLKCESGS

SEQ ID NO: 285 - protein, 208 aa, Artificial Sequence
  Sulfonylurea responsive repressor L7-2F03
MGSRLDKSKVINSALELLNEVGIEGLTTRKLAQKLGVEQPTLYWHVKNKRALLDAMAIEMLDRHATHYCPLEGESWQDFLRNNAKSMRCALLSHRDGAKVCLGTGFTEQQYEAAENSLAFLCQQGFSLENALYAMQAVGIYTLGCVLLDQELQVAKEERETPTTDSMPPLARQALELKDHQGAEPAFLFGLELIICGLEKQLKCESGS

SEQ ID NO: 286 - protein, 208 aa, Artificial Sequence
  Sulfonylurea responsive repressor L7-2G03
MGSRLDKSKVINSALELLNEVGIEGLTTRKLAQKLGVEQPTLYWHVKNKRALLDAMAIEMLDRHATHFCPLEGESWQDFLRNNAKSMRCALLSHRDGAKVCLGTGFTEQQYEAAENSMAFLCQQGFSLEHALYAMQAVGIFTLGCVLLDQELQVAKEERETPTTDSMPPLVRQGLELKDHQGAEPAFLFGLELIICGLEKQLKCESGS

SEQ ID NO: 287 - protein, 208 aa, Artificial Sequence
  Sulfonylurea responsive repressor L7-2H03
MGSRLDKSKVINSALELLNEVGIEGLTTRKLAQKLGVEQPTLYWHVKNKRALLDALAIEMLDRHATHYCPLEGESWQDFLRNNAKSMRCALLSHRDGAKVCLGTGFTEQMYETAENSMAFLCQQGFSLENAMYAMQAVGIFTLGCVLLDQELQVAKEERETPTTDSMPPLVRQVLELKDHQGAEPAFLFGLELIICGLEKQLKCESGS

SEQ ID NO: 288 - protein, 208 aa, Artificial Sequence
  Sulfonylurea responsive repressor L7-2D04
MGSRLDKSKVINSALELLNEVGIEGLTTRKLAQKLGVEQPTLYWHVKNKRALLDALAIEMLDRHATHYCPLEGESWQDFLRNNAKSMRCALLSHRDGAKVCLGTGFTEKQYESAENSLAFLCQQGFSLEHALYAMQAVGIYTLGCVLLDQELQVAKEERETPTNDSMPPLVRQVLELKDHQGAEPAFLFGLELIICGLEKQLKCESGS

SEQ ID NO: 289 - protein, 208 aa, Artificial Sequence
  Sulfonylurea responsive repressor L7-2E04
MGSRLDKSKVINSALELLNEVGIEGLTTRKLAQKLGVEQPTLYWHVKNKRALLDAMAIEMLDRHATHYCPLEGESWQDFLRNNAKSMRCALLSHRDGAKVCLGTGFTEQQYETAENSMAFLCQQGFSLENAMYAMQAACIYTLGCVLLDQELQVAKEERETPTTDSMPPLVRQVLELKDHQGAEPAFLFGLELIICGLEKQLKCESGS

SEQ ID NO: 290 - protein, 208 aa, Artificial Sequence
  Sulfonylurea responsive repressor L7-2F04
MGSRLDKSKVINSALELLNEVGIEGLTTRKLAQKLGVEQPTLYWHVKNKRALLDALAIEMLDRHATHYCPLEGESWQDFLRNNAKSMRCALLSHRDGAKVCLGTGFTEQMYETAENSMAFLCQQGFSLEHAMYAMQAVGIFTLGCVLLDQELQVAKEERETPTTDSMPPLVRQALELKDHQGAEPAFLFGLELIICGLEKQLKCESGS

SEQ ID NO: 291 - protein, 208 aa, Artificial Sequence
  Sulfonylurea responsive repressor L7-2H04
MGSRLDKSKVINSALELLNEVGIEGLTTRKLAQKLGVEQPTLYWHVKNKRALLDAMAIEMLDRHATHICPLEEESWQDFLRNNAKSMRCALLSHRDGAKVCLGTGFTEQQYETAENSMAFLCQQGFSLEHAMYAMQAACIYTLGCVLLDQELQVAKEERETPTTDSMPPLVRQVLELKDHQGAEPAFLFGLELIICGLEKQLKCESGS

SEQ ID NO: 292 - protein, 208 aa, Artificial Sequence
  Sulfonylurea responsive repressor L7-2B05
MGSRLDKSKVINSALELLNEVGIEGLTTRKLAQKLGVEQPTLYWHVKNKRALLDAMAIEMLDRHATHYCPLEGESWQDFLRNNAKSMRCALLSHRDGAKVCLGTGFTEQHYETAENSMAFLCQQGFSLEHAMYAMQAAGIYTLGCVLLDQELQVAKEERETPTTDSMPPLVRQALELKDHQGAEPAFLFGLELIICGLEKQLKCESGS

SEQ ID NO: 293 - protein, 208 aa, Artificial Sequence
  Sulfonylurea responsive repressor L7-2D05
MGSRLDKSKVINSALELLNEVGIEGLTTRKLAQKLGVEQPTLYWHVKNKRALLDAMAIEMLDRHATHYCPLEGESWQDFLRNNARSMRCALLSHRDGAKVCLGTGFTEQMYETAENSLAFLCQQGFSLENAMYAMQAAGIYTLGCVLLDQELQVAKEERETPTTDSMPPLVRQVLELKDHQGAEPAFLFGLELIICGLEKQLKCESGS

SEQ ID NO: 294 - protein, 208 aa, Artificial Sequence
  Sulfonylurea responsive repressor L7-2E05
MGSRLDKSKVINSALELLNEVGIEGLTTRKLAQKLGVEQPTLYWHVKNKRALLDAMAIEMLDRHATHYCPLEGESWQDFLRNNAKSMRCALLSHRDGAKVCLGTGFTEQQYESAENSLAFLCQQGFSLENALYAMQAVGIYTLGCVLLDQELQVAKEERETPTTDSMPPLLRQALELKDHQGAEPAFLFGLELIICGLEKQLKCESGS

SEQ ID NO: 295 - protein, 208 aa, Artificial Sequence
  Sulfonylurea responsive repressor L7-2F05
MGSRLDKSKVINSALELLNEVGIEGLTTRKLAQKLGVEQPTLYWHVKNKRALLDALAIEMLDRHATHYCPLEGESWQDFLRNNAKSMRCALLSHRDGAKVCLGTGFTEKQYESAENSMAFLCQQGFSLEHALYAMQAVGIFTLGCVLLDQELQVAKEERETPTTDSMPPLVRQVLELKDHQGAEPAFLFGLELIICGLEKQLKCESGS

SEQ ID NO: 296 - protein, 208 aa, Artificial Sequence
  Sulfonylurea responsive repressor L7-2H05
MGSRLDKSKVINSALELLNEVGIEGLTTRKLAQKLGVEQPTLYWHVKNKRALLDAMAIEMLDRHATHYCPLEGESWQDFLRNNAKSMRCALLSHRDGAKVCLGTGFTEQQYESAENSMAFLCQQGFSLEHALYAMQAAGIYTLGCVLLNQELQVAKEERETPTTDSMPPLVRQGLELKDHQGAEPAFLFGLELIICGLEKQLKCESGS

SEQ ID NO: 297 - protein, 208 aa, Artificial Sequence
  Sulfonylurea responsive repressor L7-2A06
MGSRLDKSKVINSALELLNEVGIEGLTTRKLAQKLGVEQPTLYWHVKNKRALLDAMAIEMLDSHATHYCPLEGESWQDFLRNNAKSMRCALLSHRDGAKVCLGTGFTEQQYETAENSMAFLCQQGFSLEHAMYAMQAAGIFTLGCVLLDQELQVAKEERETPTTDSMPPLVRQGLELKDHQGAEPAFLFGLELIICGLEKQLKCESGS

SEQ ID NO: 298 - protein, 208 aa, Artificial Sequence
  Sulfonylurea responsive repressor L7-2C06
MGSRLDKSKVINSALELLNEVGIEGLTTRKLAQKLGVEQPTLYWHVKNKRALLDAMAIEMLDRHATHYCPLEGESWPDFLRNNAKSMRCALLSHRDGAKVCLGTGFTEQQYETAENSLAFLCQQGFSLEHALYAMQAVGIYTLGCVLLDQELQVAKEERETPTTDSMPPLLRQGLELKDHQGAEPAFLFGLELIICGLEKQLKCESGS

SEQ ID NO: 299 - protein, 208 aa, Artificial Sequence
  Sulfonylurea responsive repressor L7-2D06
MGSRLDKSKVINSALELLNEVGIEGLTTRKLAQKLGVEQPTLYWHVKNKRALLDAMAIEMLDRHATHYCPLEGESWQDFLRNNAKSMRCALLSHRDGAKVCLGTGFTEQQYESAENSLAFLCQQGFSLENALYAMQAVGIFTLGCVLLDQELQVAKEERETPTTDSMPPLVRQALELKDHQGAEPAFLFGLELIICGLEKQLKCESGS

SEQ ID NO: 300 - protein, 208 aa, Artificial Sequence
  Sulfonylurea responsive repressor L7-2F06
MGSRLDKSKVINSALELLNEVGIEGLTTRKLAQKLGVEQPTLYWHVKNKRALLDALAIEMLDRHATHYCPLEGESWQDFLRNNAKSMRCALLSHRDGAKVCLGTGFTEKQYETAENSLAFLCQQGFSLEHALYAMQAVGIYTLGCVLLDQELQVAKEERETPTTDSMPPLVRQGLELKDHQGAEPAFLFGLELIICGLEKQLKCESGS

SEQ ID NO: 301 - protein, 208 aa, Artificial Sequence
  Sulfonylurea responsive repressor L7-2G06
MGSRLDKSKVINSALELLNEVGIEGLTTRKLAQKLGVEQPTLYWHVKNKRALLDAMAIEMLDRHATHYCPLEGESWQDFLRNNAKSMRCALLSHRDGAKVCLGTGFTEQQYETAENSMAFLCQQGFSLEHALYAMQAVGIYTLGCVLLDQELQVAKEERETPTTDSMPPLVRQGLELKDHQGAEPAFLFGLELIICGLEKQLKCESGS

SEQ ID NO: 302 - protein, 208 aa, Artificial Sequence
  Sulfonylurea responsive repressor L7-2A07
  misc_feature (110)..(110): Xaa can be any naturally occurring amino acid
  misc_feature (141)..(141): Xaa can be any naturally occurring amino acid
  misc_feature (174)..(174): Xaa can be any naturally occurring amino acid
MGSRLDKSKVINSALELLNEVGIEGLTTRKLAQKLGVEQPTLYWHVKNKRALLDAMAIEMLDRHATHYCPLEGESWQDFLRNNAKSMRCALLSHRDGAKVCLGTGFTEQXYEAAENSLAFLCQQGFSLEHALYAMQAVGIXTLGCVLLDQELQVAKEERETPTTDSMPPLVRQXLELKDHQGAEPAFLFGLELIICGLEKQLKCESGS

SEQ ID NO: 303 - protein, 208 aa, Artificial Sequence
  Sulfonylurea responsive repressor L7-2B07
MGSRLDKSKVINSALELLNEVGIEGLTTRKLAQKLGVEQPTLYWHVKNKRALLDALAIEMLDRHATHYCPLEGESWQDFLRNNAKSMRCALLSHRDGAKVCLGTGFTEQHYETAENSMAFLCQQGFSLEHAMYAMQAAGIFTLGCVLLDQELQVAKEERETPTTDSMPPLVRQGLELKDHQGAEPAFLFGLELIICGLEKQLKCESGS

SEQ ID NO: 304 - protein, 208 aa, Artificial Sequence
  Sulfonylurea responsive repressor L7-2C07
MGSRLDKSKVINSALELLNEVGIEGLTTRKLAQKLGVEQPTLYWHVKNKRALLDAMAIEMLDRHATHYCPLEGESWQDFLRNNAKSMRCALLSHRDGAKVCLGTGFTEQQYETAENSLAFLCQQGFSLEHAMYAMQAVGIFTLGCVLLDQELQVAKEERETPTTDSMPPLVRQGLELKDHQGAEPAFLFGLELIICGLEKQLKCESGS

SEQ ID NO: 305 - protein, 208 aa, Artificial Sequence
  Sulfonylurea responsive repressor L7-2D07
MGSRLDKSKVINSALELLNEVGIEGLTTRKLAQKLGVEQPTLYWHVKNKRALLDALAIEMLDRHATHYCPLEGESWQDFLRNNAKSMRCALLSHRDGAKVCLGTGFTEKQYETAENSLAFLCQQGFSLENALYAMQAAGIYTLGCVLLDQELQVAKEERETPTTDSMPPLVRQVLELKDHQGAEPAFLFGLELIICGLEKQLKCESGS

SEQ ID NO: 306 - protein, 208 aa, Artificial Sequence
  Sulfonylurea responsive repressor L7-2E07
MGSRLDKSKVINSALELLNEVGIEGLTTRKLAQKLGVEQPTLYWHVKNKRALLDALAIEMLDRHATHYCPLEGESWQDFLRNNAKSMRCALLSHRDGAKVCLGTGFTEQQYEAAENSMAFLCQQGFSLEHAMYAMQAAGIYTLGCVLLDQELQVAKEERETPTTDSMPPLLRQALELKDHQGAEPAFLFGLELIICGLEKQLKCESGS

SEQ ID NO: 307 - protein, 208 aa, Artificial Sequence; identical to SEQ ID NO: 296
  Sulfonylurea responsive repressor L7-2G07

SEQ ID NO: 308 - protein, 208 aa, Artificial Sequence
  Sulfonylurea responsive repressor L7-2B08
  misc_feature (68)..(68): Xaa can be any naturally occurring amino acid
  misc_feature (113)..(113): Xaa can be any naturally occurring amino acid
  misc_feature (130)..(130): Xaa can be any naturally occurring amino acid
  misc_feature (171)..(171): Xaa can be any naturally occurring amino acid
MGSRLDKSKVINSALELLNEVGIEGLTTRKLAQKLGVEQPTLYWHVKNKRALLDAMAIEMLDRHATHXCPLEGESWQDFLRNNAKSMRCALLSHRDGAKVCLGTGFTEQMYEXAENSMAFLCQQGFSLEXAMYAMQAVGIFTLGCVLLDQELQVAKEERETPTTDSMPPLXRQVLELKDHQGAEPAFLFGLELIICGLEKQLKCESGS

SEQ ID NO: 309 - protein, 208 aa, Artificial Sequence
  Sulfonylurea responsive repressor L7-2D08
MGSRLDKSKVINSALELLNEVGIEGLTTRKLAQKLGVEQPTLYWHVKNKRALLDAMAIEMLDRHATHYCPLEGESWQDFLRNNAKSMRCALLSHRDGAKVCLGTGFTEQQYETAENSLAFLCQQGFSLEHALYAMQAVGIYTLGCVLLDQELQVAKEERETPTTDSMPPLVRQALELKDHQGAEPAFLFGLELIICGLEKQLKCESGS

SEQ ID NO: 310 - protein, 208 aa, Artificial Sequence
  Sulfonylurea responsive repressor L7-2F08
MGSRLDKSKVINSALELLNEVGIEGLTTRKLAQKLGVEQPTLYWHVKNKRALLDAMAIEMLDRHATHYCPLEGESWQDFLRNNAKSMRCALLSHRDGAKVCLGTGFTEQQYETAENSMAFLCQQGFSLEHAMYAMQAACIFTLGCVLLDQELQVAKEERETPTTDSMPPLVRQVLELKDHQGAEPAFLFGLELIICGLEKQLKCESGS

SEQ ID NO: 311 - protein, 208 aa, Artificial Sequence
  Sulfonylurea responsive repressor L7-2G08
MGSRLDKSKVINSALELLNEVGIEGLTTRKLAQKLGVEQPTLYWHVKNKRALLDALAIEMLDRHATHYCPLEGESWQDFLRNNAKSMRCALLSHRDGAKVCLGTGFTEQMYETAENSLAFLCQQGFSLEHALYAMQAVGIFTLGCVLLDQELQVAKEERETPTTDSMPPLVRQGLELKDHQGAEPAFLFGLELIICGLEKQLKCESGS

SEQ ID NO: 312 - protein, 208 aa, Artificial Sequence
  Sulfonylurea responsive repressor L7-2B09
MGSRLDKSKVINSALELLNEVGIEGLTTRKLAQKLGVEQPTLYWHVKNKRALLDAMAIEMLDRHATHMCPLEGESWQDFLRNNAKSMRCALLSHRDGAKVCLGTGFTEQMYESAENSMAFLCQQGFSLENAMYAMQAVGIFTLGCVLLDQELQVAKEERETPTTDSMPPLARQVLELKDHQGAEPAFLFGLELIICGLEKQLKCESGS

SEQ ID NO: 313 - protein, 208 aa, Artificial Sequence
  Sulfonylurea responsive repressor L7-2C09
MGSRLDKSKVINSALELLNEVGIEGLTTRKLAQKLGVEQPTLYWHVKNKRALLDAMAIEMLDRHATHMCPLEGESWQDFLRNNAKSMRCALLSHRDGAKVCLGTGFTEQMYETAENSMAFLCQQGFSLENAMYAMQAAGIYTLGCVLLDQELQVAKEERETPTTDSMPPLVRQVLELKDHQGAEPAFLFGLELIICGLEKQLKCESGS

SEQ ID NO: 314 - protein, 208 aa, Artificial Sequence
  Sulfonylurea responsive repressor L7-2E09
MGSRLDKSKVINSALELLNEVGIEGLTTRKLAQKLGVEQPTLYWHVKNKRALLDALAIEMLDRHATHYCPLEGESWQDFLRNNAKSMRCALLSHRDGAKVCLGTGFTEQMYESAENSLAFLCQQGFSLENAMYAMQAAGIFTLGCVLLDQELQVAKEERETPTTDSMPPLVRQVLELKDHQGAEPAFLFGLELIICGLEKQLKCESGS

SEQ ID NO: 315 - protein, 208 aa, Artificial Sequence
  Sulfonylurea responsive repressor L7-2B10
MGSRLDKSKVINSALELLNEVGIEGLTTRKLAQKLGVEQPTLYWHVKNKRALLDAMAIEMLDRHATHFCPLEGESWQDFLRNNAKSMRCALLSHRDGAKVCLGTGFTEQQYEGAENSMAFLCQQGFSLENAMYAMQAAGIFTLGCVLLDQELQVAKEERETPTTDSMPPLVRQVLELKDHQGAEPAFLFGLELIICGLEKQLKCESGS

SEQ ID NO: 316 - protein, 208 aa, Artificial Sequence
  Sulfonylurea responsive repressor L7-2E10
  misc_feature (6)..(6): Xaa can be any naturally occurring amino acid
  misc_feature (82)..(82): Xaa can be any naturally occurring amino acid
  misc_feature (110)..(110): Xaa can be any naturally occurring amino acid
  misc_feature (130)..(130): Xaa can be any naturally occurring amino acid
  misc_feature (174)..(174): Xaa can be any naturally occurring amino acid
MGSRLXKSKVINSALELLNEVGIEGLTTRKLAQKLGVEQPTLYWHVKNKRALLDALAIEMLDRHATHYCPLEGESWQDFLRXNAKSMRCALLSHRDGAKVCLGTGFTEQXYETAENSLAFLCQQGFSLEXALYAMQAVGIYTLGCVLLDQELQVAKEERETPTTDSMPPLLRQXLELKDHQGAEPAFLFGLELIICGLEKQLKCESGS

SEQ ID NO: 317 - protein, 208 aa, Artificial Sequence
  Sulfonylurea responsive repressor L7-2G10
MGSRLDKSKVINSALELLNEVGIEGLTTRKLAQKLGVEQPTLYWHVKNKRALLDAMAIEMLDRHATHYCPLEGESWQDFLRNNAKSMRCALLSHRDGAKVCLGTGFTEQQYETAENSMAFLCQQGFSLEHALYAMQAAGIYTLGCVLLDQELQVAKEERETPTTDSMPPLLRQGLELKDHQGAEPAFLFGLELIICGLEKQLKCESGS

SEQ ID NO: 318 - protein, 208 aa, Artificial Sequence
  Sulfonylurea responsive repressor L7-2C11
MGSRLDKSKVINSALELLNEVGIEGLTTRKLAQKLGVEQPTLYWHVKNKRALLDAMAIEMLDRHATHYCPLEGESWQDFLRNNAKSMRCALLSHRDGAKVCLGTGFTEQQYETAENSMAFLCQQGFSLENAMYAMQAAGIFTLGCVLLDQELQVAKEERETPTTDSMPPLVRQVLELKDHQGAEPAFLFGLELIICGLEKQLKCESGS

SEQ ID NO: 319 - protein, 208 aa, Artificial Sequence
  Sulfonylurea responsive repressor L7-2D11
MGSRLDKSKVINSALELLNEVGIEGLTTRKLAQKLGVEQPTLYWHVKNKRALLDAMAIEMLDRHATHYCPLEGESWQDFLRNNARSMRCALLSHRDGAKVCLGTGFTEQMYETAENSLAFLCQQGFSLENALYAMQAAGIYTLGCVLLDQELQVAKEERETPTTDSMPPLVRQVLELKDHQGAEPAFLFGLELIICGLEKQLKCESGS

SEQ ID NO: 320 - protein, 208 aa, Artificial Sequence
  Sulfonylurea responsive repressor L7-2F11
MGSRLDKSKVINSALELLNEVGIEGLTTRKLAQKLGVEQPTLYWHVKNKRALLDALAIEMLDRHATHYCPLEGESWQDFLRNNAKSMRCALLSHRDGAKVCLGTGFTEQMYETAENSLAFLCQQGFSLENALYAMQAAGIFTLGCVLLDQELQVAKEERETPTTDSMPPLVRQALELKDHQGAEPAFLFGLELIICGLEKQLKCESGS

SEQ ID NO: 321 - protein, 208 aa, Artificial Sequence
  Sulfonylurea responsive repressor L7-2G11
MGSRLDKSKVINSALELLNEVGIEGLTTRKLAQKLGVEQPTLYWHVKNKRALLDAMAIEMLDRHATHYCPLEGESWQDFLRNNAKSMRCALLSHRDGAKVCLGTGFTEQQYESAENSMAFLCQQGFSLEHAMYAMQAAGIYTLGCVLLDQELQVAKEERETPTTDSMPPLLRQVLELNDHQGAEPAFLFGLELIICGLEKQLKCESGS

SEQ ID NO: 322 - protein, 208 aa, Artificial Sequence; identical to SEQ ID NO: 321
  Sulfonylurea responsive repressor L7-2B12

SEQ ID NO: 323 - protein, 208 aa, Artificial Sequence
  Sulfonylurea responsive repressor L7-2C12
MGSRLDKSKVINSALELLNEVGIEGLTTRKLAQKLGVEQPTLYWHVKNKRALLDAMAFEMLDRHATHYCPLEGESWQDFLRNNAKSMRCALLSHRDGAKVCLGTGFTEQQYETAENSMAFLCQQGFSLENALYAMQAVCIYTLGCVLLDQELQVAKEERETPTTDSMPPLLRQALEIKDHQGAEPAFLFGLELIICGLEKQLKCESGS

SEQ ID NO: 324 - protein, 208 aa, Artificial Sequence
  Sulfonylurea responsive repressor L7-2D12
MGSRLDKSKVINSALELLNEVGIEGLTTRKLAQKLGVEQPTLYWHVKNKRALLDAMAIEMLDRHATHYCPLEGESWQDFLRNNAKSMRCALLSHRDGAKVCLGTGFTEQQYETAENSLAFLCQQGFSLEHALYAMQAVGIYTLGCVLLDQELQVAKEERETPTTDSMPPLVRQGLELKDHQGAEPAFLFGLELIICGLEKQLKCESGS

SEQ ID NO: 325 - protein, 208 aa, Artificial Sequence
  Sulfonylurea responsive repressor L7-2F12
MGSRLDKSKVINSALELLNEVGIEGLTTRKLAQKLGVEQPTLYWHVKNKRALLDALAIEMLDRHATHVCPLEGESWQDFLRNTAKSMRCALLSHRDGAKVCLGTGFTEQQYEAAENSMAFLCQQGFSLEHALYAMQAAGIFTLGCVLLDQELQVAKEERETPTTDSMPPLVRQVLELKDHQGAEPAFLFGLELIICGLEKQLKCESGS

SEQ ID NO: 326 - protein, 208 aa, Artificial Sequence
  Sulfonylurea responsive repressor L7-2G12
MGSRLDKSKVINSALELLNEVGIEGLTTRKLAQKLGVEQPTLYWHVKNKRALLDAMAIEMLDRHATHICPLEGESWQDFLRNNAKSMRCALLSHRDGAKVCLGTGFTEQQYEAAENSLAFLCQQGFSLEHALYAMQAVGIYTLGCVLLDQELQVAKEERETPTTDSMPPLVRQALELKDHQGAEPAFLFGLELIICGLEKQLKCESGS

SEQ ID NO: 327 - protein, 208 aa, Artificial Sequence
  Sulfonylurea responsive repressor L7-3A01
MGSRLDKSKVINSALELLNEVGIEGLTTRKLAQKLGVEQPTLYWHVKNKRALLDALAIEMLDRHATHYCPLEGESWQDFLRNNAKSMRCALLSHRDGAKVCLGTGFTEKQYETAENSLAFLCQQGFSLENALYAMQAVGIFTLGCVLLDQELQVAKEERETPTTDSMPPLVRQALELKDHQGAEPAFLFGLELIICGLEKQLKCESGS

SEQ ID NO: 328 - protein, 208 aa, Artificial Sequence
  Sulfonylurea responsive repressor L7-3C01
MGSRLDKSKVINSALELLNEVGIEGLTTRKLAQKLGVEQPTLYWHVKNKRALLDAMAIEMLDRHATHLCPLEGESWQDFLRNNAKSMRSALLIHRDGAKVCLGTGFTEQQYEAAENSMAFLCQQGFSLENAMYAMQAVGIYTLGCVLLDQELQVAKEERETPTTDRMPPLARQALELKDHQGAEPAFLFGLELIICGLEKQLKCESGS

SEQ ID NO: 329 - protein, 208 aa, Artificial Sequence
  Sulfonylurea responsive repressor L7-3G01
MGSRLDKSKVINSALELLNEVGIEGLTTRKLAQKLGVEQPTLYWHVKNKRALLDAMAIEMLDRHATHYCPLEGESWQDFLRNNAKSMRCALLSHRDGAKVCLGTGFTEQQYEAAENSLAFLCQQGFSLENAMYAMQAAGIYTLGCVLLDQELQVAKEERETPTTDSMPPLVRQGLELKDHQGAEPAFLFGLELIICGLEKQLKCESGS

SEQ ID NO: 330 - protein, 208 aa, Artificial Sequence
  Sulfonylurea responsive repressor L7-3H01
MGSRLDKSKVINSALELLNEVGIEGLTTRKLAQKLGVEQPTLYWHVKNKRALLDAMAIEMLDRHATHYCPLEGESWQDFLRNNAKSMRCALLSHRDGAKVCLGTGFTEQQYEAAENSMAFLCQQGFSLENAMYSMQAVGIFTLGCVLLDQELQVAKEERETPTTDSMPPLVRQGLELKDHQGAEPAFLFGLELIICGLEKQLKCESGS

SEQ ID NO: 331 - protein, 208 aa, Artificial Sequence
  Sulfonylurea responsive repressor L7-3A02
MGSRLDKSKVINSALELLNEVGIEGLTTRKLAQKLGVEQPTLYWHVKNKRALLDALAIEMLDRHATHYCPLEGESWQDFLRNNAKSMRCALLSHRDGAKVCLGTGFTEKQYESAENSLAFLCQQGFSLEHALYAMQAVGIYTLGCVLLDQELQVAKEERETPTTDSMPPLVRQALELKDHQGAEPAFLFGLELIICGFEKQLKCESGS

SEQ ID NO: 332 - protein, 208 aa, Artificial Sequence
  Sulfonylurea responsive repressor L7-3B02
  misc_feature (110)..(110): Xaa can be any naturally occurring amino acid
  misc_feature (171)..(171): Xaa can be any naturally occurring amino acid
MGSRLDKSKVINSALELLNEVGIEGLTTRKLAQKLGVEQPTLYWHVKNKRALLDAMAIEMLDRHATHYCPLEGESWQDFLRNNAKSMRCALLSHRDGAKVCLGTGFTEQXYETAENSMAFLCQQGFSLENALYAMQAAGIYTLGCVLLDQELQVAKEERETPTTDSMPPLXRQALELKDHQGAEPAFLFGLELIICGLEKQLKCESGS

SEQ ID NO: 333 - protein, 208 aa, Artificial Sequence
  Sulfonylurea responsive repressor L7-3D02
MGSRLDKSKVINSALELLNEVGIEGLTTRKLAQKLGVEQPTLYWHVKNKRALLDAMAIEMLDRHATHYCPLEGESWQDFLRNNAKSMRCALLSHRDGAKVCLGTGFTEQQYETAENSMAFLCQQGFSLENAMYAMQAAGIFTLGCVLLDQELRVAKEERETPTTDSMPPLLRQVLELKDHQGAEPAFLFGLELIICGLEKQLKCESGS

SEQ ID NO: 334 - protein, 208 aa, Artificial Sequence
  Sulfonylurea reponsive repressor L7-3G02
MGSRLDKSKVINSALELLNEVGIEGLTTRKLAQKLGVEQPTLYWHVKNKRALLDAMAIEMLDRHATHYCPLEGESWQDFLRNNAKSMRCALLSHRDGAKVCLGTGFTEQQYETAENSLAFLCQQGFSLENAMYAMQAVGIFTLGCVLLDQELQVAKEERETPTTDSMPPLLRQVLELKDHQGAEPAFLFGLELIICGLEKQLKCESGS

SEQ ID NO: 335 - protein, 208 aa, Artificial Sequence
  Suflonylurea responsive repressor L7-3H02
MGSRLDKSKVINSALELLNEVGIEGLTTRKLAQKLGVEQPTLYWHVKNKRALLDAMAIEMLDRHATHYCPLEGESWQDFLRNNAKSMRCALLSHRDGAKVCLGTGFTEQQYEGAENSMAFLCQQGFSLENALYAMQAVGIYTLGCVLLDQELQVAKEERETPTTDSMPSLVRQVLELKDHQGAEPAFLFGLELIICGLEKQLKCESGS

SEQ ID NO: 336 - protein, 208 aa, Artificial Sequence
  Sulfonylurea responsive repressor L7-3B03
  misc_feature (56)..(56): Xaa can be any naturally occurring amino acid
  misc_feature (113)..(113): Xaa can be any naturally occurring amino acid
MGSRLDKSKVINSALELLNEVGIEGLTTRKLAQKLGVEQPTLYWHVKNKRALLDAXAIEMLDRHATHYCPLEGESWQDFLRNNAKSMRCALLSHRDGAKVCLGTGFTEQQYEXAENSLAFLCQQGFSLEHALYAMQAAGIYTLGCVLLDQELQVAKEERETPTTDSMPPLLRQALELKDHQGAEPAFLFGLELIICGLEKQLKCESGS

SEQ ID NO: 337 - protein, 208 aa, Artificial Sequence
  Sulfonylurea responsive repressor L7-3C03
MGSRLDKSKVINSALELLNEVGIEGLTTRKLAQKLGVEQPTLYWHVKNKRALLDALAIEMLDRHATHYCPLEGESWQDFLRNNAKSMRCALLSHRDGAKVCLGTGFTEQMYETAENSMAFLCQQGFSLENAMYAMQAAGIYTLGCVLLDQELQVAKEERETPTTDSMPPLVRQGLELKDHQGAEPAFLFGLELIICGLEKQLKCESGS

SEQ ID NO: 338 - protein, 208 aa, Artificial Sequence; identical to SEQ ID NO: 235
  Sulfonylurea responsive repressor L7-3E03

SEQ ID NO: 339 - protein, 208 aa, Artificial Sequence
  Sulfonylurea responsive repressor L7-3G03
MGSRLDKSKVINSALELLNEVGIEGLTTRKLAQKLGVEQPTLYWHVKNKRALLDALAIEMLDRHATHYCPLEGESWQDFLRNNAKSMRCALLSHRDGAKVCLGTGFTEKQYETAENSMAFLCQQGFSLEHAMYAMQAAGIYTLGCVLLDQELQVAKEERETPTTDSMPPLVRQALELKDHQGAEPAFLFGLELIICGLEKQLKCESGS

SEQ ID NO: 340 - protein, 208 aa, Artificial Sequence
  Sulfonylurea responsive repressor L7-3H03
MGSRLDKSKVINSALELLNEVGIEGLTTRKLAQKLGVEQPTLYWHVKNKRALLDAMAIEMLDRHATHLCPLEGESWQDFLRNNAKSMRCALLSHRDGAKVCLGTGFTEQMYETAENSLAFLCQQGFSLENALYAMQAAGIYTLGCVLLDQELQVAKEERETPTTDSMPPLVRQVLELKDHQGAEPAFLFGLELIICGLEKQLKCESGS

SEQ ID NO: 341 - protein, 208 aa, Artificial Sequence
  Sulfonylurea responsive repressor L7-3B04
  misc_feature (109)..(109): Xaa can be any naturally occurring amino acid
MGSRLDKSKVINSALELLNEVGIEGLTTRKLAQKLGVEQPTLYWHVKNKRALLDALAIEMLDRHATHYCPLEGESWQDFLRNNAKSMRCALLSHRDGAKVCLGTGFTEXQYEAAENSLAFLCQQGFSLEHALYAMQAVGIYTLGCVLLDQELQVAKEERETPTTDSMPPLVRQALELKDHQGAEPAFLFGLELIICGLEKQLKCESGS

SEQ ID NO: 342 - protein, 208 aa, Artificial Sequence
  Sulfonylurea responsive repressor L7-3E04
MGSRLDKSKVINSALELLNEVGIEGLTTRKLAQKLGVEQPTLYWHVKNKRALLDAMAIEMLDRHATHYCPLEGESWQDFLRNNAKSMRCALLSHRDGAKVCLGTGFTEQQYESAENSLAFLCQQGFSLEHAMYAMQAAGIFTLGCVLLDQELQVAKEERETPTTDSMPPLVRQALELKDHQGAEPAFLFGLELIICGLEKQLKCESGS

SEQ ID NO: 343 - protein, 208 aa, Artificial Sequence; identical to SEQ ID NO: 274
  Sulfonylurea responsive repressor L7-3G04

SEQ ID NO: 344 - protein, 208 aa, Artificial Sequence
  Sulfonylurea responsive repressor L7-3A05
MGSRLDKSKVINSALELLNEVGIEGLTTRKLAQKLGVEQPTLYWHVKNKRALLDALAIEMLDRHATHYCPLEGESWQDFLRNNAKSMRCALLSHRDGAKVCLGTGFTEQMYEAAENSLAFLCQQGFSLEHAMYAMQAVGIYTLGCVLLDQELQVAKEERETPTTDSMPPLVRQGLELKDHQGAEPAFLFGLELIICGLEKQLKCESGS

SEQ ID NO: 345 - protein, 208 aa, Artificial Sequence
  Sulfonylurea responsive repressorL7-3B05
  misc_feature (56)..(56): Xaa can be any naturally occurring amino acid
  misc_feature (68)..(68): Xaa can be any naturally occurring amino acid
  misc_feature (110)..(110): Xaa can be any naturally occurring amino acid
  misc_feature (130)..(130): Xaa can be any naturally occurring amino acid
  misc_feature (139)..(139): Xaa can be any naturally occurring amino acid
  misc_feature (141)..(141): Xaa can be any naturally occurring amino acid
MGSRLDKSKVINSALELLNEVGIEGLTTRKLAQKLGVEQPTLYWHVKNKRALLDAXAIEMLDRHATHXCPLEGESWQDFLRNNAKSMRCALLSHRDGAKVCLGTGFTEQXYETAENSLAFLCQQGFSLEXAMYAMQAAXIXTLGCVLLDQELQVAKEERETPTTDSMPPLVRQALELKDHQGAEPAFLFGLELIICGLEKQLKCESGS

SEQ ID NO: 346 - protein, 208 aa, Artificial Sequence
  Sulfonylurea responsive repressor L7-3H05
  misc_feature (171)..(171): Xaa can be any naturally occurring amino acid
MGSRLDKSKVINSALELLNEVGIEGLTTRKLAQKLGVEQPTLYWHVKNKRALLDAMAIEMLDRHATHYCPLEGESWQDFLRNNAKSMRCALLSHRDGAKVCLGTGFTEQQYESAENSLAFLCQQGFSLENAMYAMQAAGIYTLGCVLLDQELQVAKEERETPTTDSMPPLXRQALELKDHQGAEPAFLFGLELIICGLEKQLKCESGS

SEQ ID NO: 347 - protein, 208 aa, Artificial Sequence
  Sulfonylurea responsive repressor L7-3B06
MGSRLDKSKVINSALELLNEVGIEGLTTRKLAQKLGVEQPTLYWHVKNKRALLDAMAIEMLDRHATHICPLEGESWQDFLRNNAKSMRCALLSHRDGAKVCLGTGFTEQQYETAENSLAFLCQQGFSLEHAMYAMQAAGIYTLGCVLLDQELQVAKEERETPTTDSMPPLVRQVLELKDHQGAEPAFLFGLELIICGLEKQLKCESGS

SEQ ID NO: 348 - protein, 208 aa, Artificial Sequence
  Sulfonylurea responsive repressor L7-3D06
  misc_feature (130)..(130): Xaa can be any naturally occurring amino acid
MGSRLDKSKVINSALELLNEVGIEGLTTRKLAQKLGVEQPTLYWHVKNKRALLDAMAIEMLDRHATHMCPLEGESWQDFLRNNAKSMRCALLSHRDGAKVCLGTGFTEQQYESAENSMAFLCQQGFSLEXAMYAMQAVGIFTLGCVLLDQELQVAKEERETPTTDSMPPLVRQGLELKDHQGAEPAFLFGLELIICGLEKQLKCESGS

SEQ ID NO: 349 - protein, 208 aa, Artificial Sequence
  Sulfonylurea responsive repressor L7-3E06
MGSRLDKSKVINSALELLNEVGIEGLTTRKLAQKLGVEQPTLYWHVKNKRALLDALAIEMLDRHATHYCPLEGESWQDFLRNNAKSMRCALLSHRDGAKVCLGTGFTEKQYESAENSMAFLCQQGFSLEHALYAMQAVGIYTLGCVLLDQELQVAKEERETPTTDSMPPLVRQGLELKDHQGAEPAFLFGLELIICGLEKQLKCESGS

SEQ ID NO: 350 - protein, 208 aa, Artificial Sequence
  Sulfonylurea responsive repressor L7-3A07
MGSRLDKSKVINSALELLNEVGIEGLTTRKLAQKLGVEQPTLYWHVKNKRALLDAMAIEMLDRHATHYCPLEGESWQDFLRNNAKSMRCALLSHRDGAKVCLGTGFTEQQYEGAENSLAFLCQQGFSLEHAMYAMQAVGIFTLGCVLLDQELQVAKEERETPTTDSMPPLVRQGLELKDHQGAEPAFLFGLELIICGLEKQLKCESGS

SEQ ID NO: 351 - protein, 208 aa, Artificial Sequence
  Sulfonylurea responsive repressor L7-3C07
MGSRLDKSKVINSALELLNEVGIEGLTTRKLAQKLGVEQPTLYWHVKNKRALLDAMAIEMLDRHATHYCPLEGESWQDFLRNNAKSMRCALLSHRDGAKVCLGTGFTEQQYESAENSLAFLCQQGFSLENAMYAMQAVGIFTLGCVLLDQELQVAKEERETPTTDSMPPLLRQVLELKDHQGAEPAFLFGLELIICGLEKQLKCESGS

SEQ ID NO: 352 - protein, 208 aa, Artificial Sequence
  Sulfonylurea responsive repressor L7-3F07
MGSRLDKSKVINSALELLNEVGIEGLTTRKLAQKLGVEQPTLYWHVKNKRALLDAMAIEMLDRHATHICPLEGESWQDFLRNNAKSMRCALLSHRDGAKVCLGTGFTEQQYETAENSLAFLCQQGFSLENAMYAMQAVGIYTLGCVLLDQELQVAKEERETPTTDSMPPLVRQALELKDHQGAEPAFLFGLELIICGLEKQLKCESGS

SEQ ID NO: 353 - protein, 208 aa, Artificial Sequence
  Sulfonylurea responsive repressor L7-3A08
MGSRLDKSKVINSALELLNEVGIEGLTTRKLAQKLGVEQPTLYWHVKNKRALLDAMAIEMLDRHATHYCPLEGESWQDFLRNNAKSMRCALLSQRDGAKVCLGTGFTEQQYEAAENSLAFLCQQGFSLENAMYAMQAVGIFTLGCVLLDQELQVAKEERETPTTDSMPPLVRQALELKDHQGAEPAFLFGLELIICGLEKQLKCESGS

SEQ ID NO: 354 - protein, 208 aa, Artificial Sequence
  Sulfonylurea responsive repressor L7-3B08
MGSRLDKSKVINSALELLNEVGIEGLTTRKLAQKLGVEQPTLYWHVKNKRALLDAMAIEMLDRHATHYCPLEGESWQDFLRNNAKSMRCALLSHRDGAKVCLGTGFTEQQYEGAENSMAFLCQQGFSLENALYAMQAVGIYTLGCVLLDQELQVAKEERETPTTDSMPPLVRQVLELKDHQGAEPAFLFGLELIICGLEKQLKCESGS

SEQ ID NO: 355 - protein, 208 aa, Artificial Sequence
  Sulfonylurea responsive repressor L7-3C08
MGSRLDKSKVINSALELLNEVGIEGLTTRKLAQKLGVEQPTLYWHVKNKRALLDAMAIEMLDRHATHYCPLEGESWQDFLRNNAKSMRCALLSHRDGAKVCLGTGFTEQQYEGAENSMAFLCQQGFSLENAMYAMQAAGIYTLGCVLLDQELQVAKEERETPTTDSMPPLVRQALELKDHQGAEPAFLFGLELIICGLEKQLKCESGS

SEQ ID NO: 356 - protein, 208 aa, Artificial Sequence
  Sulfonylurea responsive repressor L7-3F08
  misc_feature (56)..(56): Xaa can be any naturally occurring amino acid
  misc_feature (110)..(110): Xaa can be any naturally occurring amino acid
  misc_feature (132)..(132): Xaa can be any naturally occurring amino acid
  misc_feature (138)..(138): Xaa can be any naturally occurring amino acid
MGSRLDKSKVINSALELLNEVGIEGLTTRKLAQKLGVEQPTLYWHVKNKRALLDAXAIEMLDRHATHYCPLEGESWQDFLRNNAKSMRCALLSHRDGAKVCLGTGFTEQXYEAAENSMAFLCQQGFSLEHAXYAMQAXGIYTLGCVLLDQELQVAKEERETPTTDSMPPLVRQVLELKDHQGAEPAFLFGLELIICGLEKQLKCESGS

SEQ ID NO: 357 - protein, 208 aa, Artificial Sequence
  Sulfonylurea responsive repressor L7-3G08
  misc_feature (53)..(53): Xaa can be any naturally occurring amino acid
  misc_feature (56)..(56): Xaa can be any naturally occurring amino acid
  misc_feature (63)..(63): Xaa can be any naturally occurring amino acid
  misc_feature (80)..(80): Xaa can be any naturally occurring amino acid
  misc_feature (86)..(86): Xaa can be any naturally occurring amino acid
  misc_feature (89)..(89): Xaa can be any naturally occurring amino acid
  misc_feature (99)..(99): Xaa can be any naturally occurring amino acid
  misc_feature (102)..(102): Xaa can be any naturally occurring amino acid
  misc_feature (106)..(106): Xaa can be any naturally occurring amino acid
  misc_feature (110)..(110): Xaa can be any naturally occurring amino acid
  misc_feature (121)..(121): Xaa can be any naturally occurring amino acid
  misc_feature (130)..(130): Xaa can be any naturally occurring amino acid
  misc_feature (132)..(132): Xaa can be any naturally occurring amino acid
  misc_feature (140)..(141): Xaa can be any naturally occurring amino acid
  misc_feature (148)..(148): Xaa can be any naturally occurring amino acid
  misc_feature (171)..(171): Xaa can be any naturally occurring amino acid
  misc_feature (174)..(174): Xaa can be any naturally occurring amino acid
  misc_feature (198)..(198): Xaa can be any naturally occurring amino acid
MGSRLDKSKVINSALELLNEVGIEGLTTRKLAQKLGVEQPTLYWHVKNKRALXDAXAIEMLDXHATHYCPLEGESWQDFXRNNAKXMRXALLSHRDGAXVCXGTGXTEQXYETAENSLAFXCQQGFSLEXAXYAMQAVGXXTLGCVLXDQELQVAKEERETPTTDSMPPLXRQXLELKDHQGAEPAFLFGLELIICGXEKQLKCESGS

SEQ ID NO: 358 - protein, 208 aa, Artificial Sequence; identical to SEQ ID NO: 344
  Sulfonylurea responsive repressor L7-3B09

SEQ ID NO: 359 - protein, 208 aa, Artificial Sequence
  Sulfonylurea responsive repressor L7-3F09
MGSRLDKSKVINSALELLNEVGIEGLTTRKLAQKLGVEQPTLYWHVKNKRALLDAMAIEMLDRHATHYCPLEGESWQDFLRNNAKSMRCALLSHRDGAKVCLGTGFTEQQYEAAENSMAFLCQQGFSLEHALYAMQAACIYTLGCVLLDQELQVAKEERETPTTDSMPPLVRQALELKDHQGAEPAFLFGLELIICGLEKQLKCESGS

SEQ ID NO: 360 - protein, 208 aa, Artificial Sequence; identical to SEQ ID NO: 309
  Sulfonylurea responsive repressor L7-3A10

SEQ ID NO: 361 - protein, 208 aa, Artificial Sequence
  Sulfonylurea responsive repressor L7-3B10
MGSRLDKSKVINSALELLNEVGIEGLTTRKLAQKLGVEQPTLYWHVKNKRALLDAMAIEMLDRHATHYCPLEGESWQDFLRNNAKSMRCALLSHRDGAKVCLGTGFTEQHYESAENSLAFLCQQGFSLEHAMYAMQAVGIYTLGCVLLDQELQVAKEERETPTTDSMPPLVRQALELKDHQGAEPAFLFGLELIICGLEKQLKCESGS

SEQ ID NO: 362 - protein, 208 aa, Artificial Sequence
  Sulfonylurea responsive repressor L7-3C10
  misc_feature (138)..(138): Xaa can be any naturally occurring amino acid
MGSRLDKSKVINSALELLNEVGIEGLTTRKLAQKLGVEQPTLYWHVKNKRALLDAMAIEMLDRHATHYCPLEGESWQDFLRNNAKSMRCALLSHRDGAKVCLGTGFTEQQYEAAENSMAFLCQQGFSLEHAMYAMQAXGIYTLGCVLLDQELQVAKEERETPTTDSMPPLVRQALELKDHQGAEPAFLFGLELIICGLEKQLKCESGS

SEQ ID NO: 363 - protein, 208 aa, Artificial Sequence
  Sulfonylurea responsive repressor L7-3G10
MGSRLDKSKVINSALELLNEVGIEGLTTRKLAQKLGVEQPTLYWHVKNKRALLDAMAIEMLDRHATHYCPLEGESWQDFLRNNAKSMRCALLSHRDGAKVCLGTGFTEQQYETAENSMAFLCQQGFSLEHAMYAMQAAGIYTLGCVLLDQELQVAKEERETPTTDSMPPLLRQALELKDHQGAEPAFLFGLELIICGLEKQLKCESGS

SEQ ID NO: 364 - protein, 208 aa, Artificial Sequence
  Sulfonylurea responsive repressor L7-3A11
MGSRLDKSKVINSALELLNEVGIEGLTTRKLAQKLGVEQPTLYWHVKNKRALLDAMAIEMLDRHATHFCPLEGESWQDFLRNNAKSMRCALLSHRDGAKVCLGTGFTEQQYETAENSLAFLCQQGFSLENALYAMQAACIYTLGCVLLDQELQVAKEERETPTTDSMPPLVRQALELKDHQGAEPAFLFGLELIICGLEKQLKCESGS

SEQ ID NO: 365 - protein, 208 aa, Artificial Sequence
  Sulfonylurea responsive repressor L7-3C11
MGSRLDKSKVINSALELLNEVGIEGLTTRKLAQKLGVEQPTLYWHVKNKRALLDAMAIEMLDRHATHYCPLEGESWQDFLRNNAKSMRCALLSHRDGAKVCLGTGFTEQQYESAENSMAFLCQQGFSLENAMYAMQAAGIYTLGCVLLDQELQVAKEERETPTTDSMPPLVRQGLELKDHQGAEPAFLFGLELIICGLEKQLKCESGS

SEQ ID NO: 366 - protein, 208 aa, Artificial Sequence
  Sulfonylurea responsive repressor L7-3E11
MGSRLDKSKVINSALELLNEVGIEGLTTRKLAQKLGVEQPTLYWHVKNKRALLDAMAIEMLDRHATHMCPLEGESWQDFLRNNAKSMRCALLSHRDGAKVCLGTGFTEQQYESAENSMAFLCQQGFSLEHAMYAMQAAGIYTLGCVLLDQELQVAKEERETPTTDSMPPLLRQALELKDHQGAEPAFLFGLELIICGLEKQLKCESGS

SEQ ID NO: 367 - protein, 208 aa, Artificial Sequence
  Sulfonylurea responsive repressor L7-3G11
  misc_feature (68)..(68): Xaa can be any naturally occurring amino acid
  misc_feature (113)..(113): Xaa can be any naturally occurring amino acid
  misc_feature (171)..(171): Xaa can be any naturally occurring amino acid
  misc_feature (174)..(174): Xaa can be any naturally occurring amino acid
MGSRLDKSKVINSALELLNEVGIEGLTTRKLAQKLGVEQPTLYWHVKNKRALLDAMAIEMLDRHATHXCPLEGESWQDFLRNNAKSMRCALLSHRDGAKVCLGTGFTEQQYEXAENSMAFLCQQGFSLENAMYAMQAVGIYTLGCVLLDQELQVAKEERETPTTDSMPPLXRQXLELKDHQGAEPAFLFGLELIICGLEKQLKCESGS

SEQ ID NO: 368 - protein, 208 aa, Artificial Sequence
  Sulfonylurea responsive repressor L7-3A12
MGSRLDKSKVINSALELLNEVGIEGLTTRKLAQKLGVEQPTLYWHVKNKRALLDALAIEMLDRHATHYCPLEGESWQDFLRNNAKSMRCALLSHRDGAKVCLGTGFTEQHYEAAENSMAFLCQQGFSLENAMYAMQAVGIFTLGCVLLDQELQVAKEERETPTTDSMPPLVRQALELKDHQGAEPAFLFGLELIICGLEKQLKCESGS

SEQ ID NO: 369 - protein, 208 aa, Artificial Sequence
  Sulfonylurea responsive repressor L7-3B12
MGSRLDKSKVINSALELLNEVGIEGLTTRKLAQKLGVEQPTLYWHVKNKRALLDALAIEMLDRHATHYCPLEGESWQDFLRNNAKSMRCALLSHRDGAKVCLGTGFTEQMYESAENSMAFLCQQGFSLEHAMYAMQAAGIYTLGCVLLDQELQVAKEERETPTTDSMPPLLRQALELKDHQGAEPAFLFGLELIICGLEKQLKCESGS

SEQ ID NO: 370 - protein, 208 aa, Artificial Sequence
  Sulfonylurea responsive repressor L7-3C12
  misc_feature (110)..(110): Xaa can be any naturally occurring amino acid
  misc_feature (113)..(113): Xaa can be any naturally occurring amino acid
  misc_feature (141)..(141): Xaa can be any naturally occurring amino acid
  misc_feature (171)..(171): Xaa can be any naturally occurring amino acid
MGSRLDKSKVINSALELLNEVGIEGLTTRKLAQKLGVEQPTLYWHVKNKRALLDAMAIEMLDRHATHYCPLEGESWQDFLRNNAKSMRCALLSHRDGAKVCLGTGFTEQXYEXAENSLAFLCQQGFSLEHALYAMQAACIXTLGCVLLDQELQVAKEERETPTTDSMPPLXRQGLELKDHQGAEPAFLFGLELIICGLEKQLKCESGS

SEQ ID NO: 371 - protein, 208 aa, Artificial Sequence
  Sulfonylurea responsive repressor L7-3E12
MGSRLDKSKVINSALELLNEVGIEGLTTRKLAQKLGVEQPTLYWHVKNKRALLDAMAIEMLDRHATHYCPLEGESWQDFLRNNAKSMRCALLSHRDGAKVCLGTGFTEQQYESAENSMAFLCQQGFSLEHAMYAMQAVGIYTLGCVLLDQELQVAKEERETPTTDSMPPLLRQALELKDHQGAEPAFLFGLELIICGLEKQLKCESGS

SEQ ID NO: 372 - protein, 208 aa, Artificial Sequence
  Sulfonylurea responsive repressor L7-3F12
MGSRLDKSKVINSALELLNEVGIEGLTTRKLAQKLGVEQPTLYWHVKNKRALLDAMAIEMLDRHATHVCPLEGESWQDFLRNNAKSMRCALLSHRDGAKVCLGTGFTEQHYESAENSLAFLCQQGFSLEHALYAMQAVGIYTLGCVLLDQELQVAKEERETPTTDSMPPLVRQALELKDHQGAEPAFLFGLELIICGLEKQLKCESGS

SEQ ID NO: 373 - protein, 208 aa, Artificial Sequence
  Sulfonylurea responsive repressor L7-3G12
MGSRLDKSKVINSALELLNEVGIEGLTTRKLAQKLGVEQPTLYWHVKNKRALLDAMAIEMLDRHATHFCPLEGESWQDFLRNNAKSMRCALLSHRDGAKVCLGTGFTEQQYETAENSLAFLCQQGFSLENAMYAMQAVGIYTLGCVLLDQELQVAKEERETPTTDSMPPLVRQGLELKDHQGAEPAFLFGLELIICGLEKQLKCESGS

SEQ ID NO: 374 - protein, 208 aa, Artificial Sequence
  Sulfonylurea responsive repressor L7-4A01
MGSRLDKSKVINSALELLNEVGIEGLTTRKLAQKLGVEQPTLYWHVKNKRALLDAMAIEMLDRHATHYCPLEGESWQDFLRNNAKSMRCALLSHRDGAKVCLGTGFTEQQYETAENSLAFLCQQGFSLENALYAMQAACIYTLGCVLLDQELQVAKEERETPTTDSMPPLVRQVLELKDHQGAEPAFLFGLELIICGLEKQLKCESGS

SEQ ID NO: 375 - protein, 208 aa, Artificial Sequence
  Sulfonylurea responsive repressor L7-4A03
  misc_feature (8)..(10): Xaa can be any naturally occurring amino acid
MGSRLDKXXXINSALELLNEVGIEGLTTRKLAQKLGVEQPTLYWHVKNKRALLDAMAIEMLDRHATHYCPLEGESWQDFLRNNAKSMRCALLSHRDGAKVCLGTGFTEQQYDTAENSLAFLCQQGFSLENALYAMQAVGIYTLGCVLLDQELQVAKEERETPTTDSMPPLVRQVLELKDHQGAEPVFLFGLELIICGLEKQLKCESGS

SEQ ID NO: 376 - protein, 208 aa, Artificial Sequence
  Sulfonylurea responsive repressor L7-4A04
MGSRLDKSKVINSALELLNEVGIEGLTTRKLAQKLGVEQPTLYWHVKNKRALLDALAIEMLDRHATHYCPLEGESWQDFLRNNALSMRCALLSHRDGAKVCLGTGFTEKQYETAENSMAFLCQQGFSLEHAMYAMQAAGIYTLGCVLLDQELQVAKEERETPTTDSMPPLVRQALELKDHQGAEPAFLFGLELIICGLEKQLKCESGS

SEQ ID NO: 377 - protein, 208 aa, Artificial Sequence
  Sulfonylurea responsive repressor L7-4A06
MGSRLDKSKVINSALELLNEVGIEGLTTRKLAQKLGVEQPTLYWHVKNKRALLDAMAIEMLDRHATHYCPLEGESWQDFLRNNAKSMRCALLSHRDGAKVCLGTGFTEQQYETAENSLAFLCQQGFSLENAMYAMQAVGIYTLGCVLLDQELQVAKEERETPTTDSMPPLLRQVLELKDHQGAEPAFLFGLELIICGLEKQLKCESGS

SEQ ID NO: 378 - protein, 208 aa, Artificial Sequence
  Sulfonylurea responsive repressor L7-4A08
  misc_feature (7)..(9): Xaa can be any naturally occurring amino acid
MGSRLDXXXVINSALELLNEVGIEGLTTRKLAQKLGVEQPTLYWHVKNKRALLDAMAIEMLDRHATHYCPLEGESWQDFLRNNAKSMRCALLSHRDGAKVCLGTGFTEQQYEAAENSMAFLCQQGFSLEHAMYAMQAACIYTLGCVLLDQELQVAKEERETPTTDSMPPLVRQALELKDHQGAEPAFLFGLELIICGLEKQLKCESGS

SEQ ID NO: 379 - protein, 208 aa, Artificial Sequence
  Sulfonylurea responsive repressor L7-4A09
  misc_feature (56)..(56): Xaa can be any naturally occurring amino acid
  misc_feature (110)..(110): Xaa can be any naturally occurring amino acid
  misc_feature (171)..(171): Xaa can be any naturally occurring amino acid
MGSRLDKSKVINSALELLNEVGIEGLTTRKLAQKLGVEQPTLYWHVKNKRALLDAXAIEMLDRHATHYCPLEGESWQDFLRNNAKSMRCALLSHRDGAKVCLGTGFTEQXYEIAENSLAFLCQQGFSLEHAMYAMQAAGIYTLGCVLLDQELQVAKEERETPTTDSMPPLXRQALELKDHQGAEPAFLFGLELIICGLEKQLKCESGS

SEQ ID NO: 380 - protein, 208 aa, Artificial Sequence
  Sulfonylurea responsive repressor L7-4A12
MGSRLDKSKVINSALELLNEVGIEGLTTRKLAQKLGVEQPTLYWHVKNKRALLDALAIEMLDRHATHYCPLEGESWQDFLRNNAKSMRCALLSHRDGAKVCLGTGFTEKQYEAAENSLAFLCQQGFSLEHALYAMQAVGIYTLGCVLLDQELQVAKEERETPTTDSMPPLVRQVLELKDHQGAEPAFLFGLELIICGLEKQLKCESGS

SEQ ID NO: 381 - protein, 208 aa, Artificial Sequence
  Sulfonylurea responsive repressor L7-4B03
  misc_feature (8)..(10): Xaa can be any naturally occurring amino acid
  misc_feature (19)..(19): Xaa can be any naturally occurring amino acid
MGSRLDKXXXINSALELLXEVGIEGLTTRKLAQKLGVEQPTLYWHVKNKRALLDAMAIEMLDRHATHYCPLEGESWQDFLRNNAKSMRCALLSHRDGAKVCLGTGFTEKLYESAENSLAFLCQQGFSLENAMYAMQAVCIFTLGCVLLDQELQVAKEERETPTTDSMPPLLRQGLELKDHQGAEPAFLFGLELIICGLEKQLKCESGS

SEQ ID NO: 382 - protein, 208 aa, Artificial Sequence
  Sulfonylurea responsive repressor L7-4B04
MGSRLDKSKVINSALELLNEVGIEGLTTRKLAQKLGVEQPTLYWHVKNKRALLDAMAIEMLDRHATHYCPLEGESWQDFLRNNAKSMRCALLSHRDGAKVCLGTGFTEQQYESAENSLAFLCQQGFSLEHAMYAMQAVGIFTLGCVLLDQELQVAKEERETPTTDSMPPLLRQALELKDHQGAEPAFLFGLELIICGLEKQLKCESGS

SEQ ID NO: 383 - protein, 208 aa, Artificial Sequence
  Sulfonylurea responsive repressor L7-4B06
MGSRLDKSKVINSALELLNEVGIEGLTTRKLAQKLGVEQPTLYWHVKNKRALLDALAIEMLDRHATHYCPLEGESWQDFLRNNAKSMRCALLSHRDGAKVCLGTGFTEQMYEGAENSMAFLCQQGFSLEHAMYAMQAAGIYTLGCVLLDQELQVAKEERETPTTDSMPPLVRQALELKDHQGAEPAFLFGLELIICGLEKQLKCESGS

SEQ ID NO: 384 - protein, 208 aa, Artificial sequence
  Sulfonylurea responsive repressor  L7-4B07
  misc_feature (9)..(10): Xaa can be any naturally occurring amino acid
  misc_feature (139)..(139): Xaa can be any naturally occurring amino acid
MGSRLDKSXXINSALELLNEVGIEGLTTRKLAQKLGVEQPTLYWHVKNKRALLDAMAIEMLDRHATHYCPLEGESWQDFLRNNAKSMRCALLSHRDGAKVCLGSGFTEQQYETAENSMAFLCQQGFSLENAMYAMQAAXIFTLGCVLLDQELQVAKEERETPTTDSMPPLVRQVLELKDHQGAEPAFLFGLELIICGLEKQLKCESGS

SEQ ID NO: 385 - protein, 208 aa, Artificial sequence
  Sulfonylurea responsive repressor L7-4C01
  misc_feature (18)..(19): Xaa can be any naturally occurring amino acid
  misc_feature (21)..(21): Xaa can be any naturally occurring amino acid
MGSRLDKSKVINSALELXXEXGIEGLTTRKLAQKLGVEQPTLYWHVKNKRALLDAMAIEMLDRHATHICPLEEESWQDFLRNNAKSMRCALLSHRDGAKVCLGTGFTEQQYETAENSMAFLCQQGFSLEHAMYAMQAACIYTLGCVLLDQELQVAKEERETPTTDSMPPLVRQVLELKDHQGAEPAFLFGLELIICGLEKQLKCESGS

SEQ ID NO: 386 - protein, 208 aa, Artificial sequence
  Sulfonylurea responsive repressor L7-4C03
  misc_feature (8)..(10): Xaa can be any naturally occurring amino acid
MGSRLDKXXXINSALELLNEVGIEGLTTRKLAQKLGVEQPTLYWHVKNKRALLDAMAIEMLDRHATHVCPLEGESWQDFLRNNAKSMRCALLSHRDGAKVCLGTGFTEQQYESAENSLAFLCQQGFSLEHAMYAMQAAGIFTLGCVLLDQELQVAKEERETPTTDSMPPLVRQALELKDHQGAEPAFLFGLELIICGLEKQLKCESGS

SEQ ID NO: 387 - protein, 208 aa, Artificial sequence
  Sulfonylurea responsive repressor L7-4C04
  misc_feature (6)..(7): Xaa can be any naturally occurring amino acid
MGSRLXXSKVINSALELLNEVGIEGLTTRKLAQKLGVEQPTLYWHVKNKRALLDAMAIEMLDRHATHMCPLEGESWQDFLRNNAKSMRCALLSHRDGAKVCLGTGFTEQHYETAENSMAFLCQQGFSLENAMYAMQAAGIYTLGCVLLDQELQVAKEERETPTTDSMPPLVRQVLELKDHQGAEPAFLFGLELIICGLEKQLKCESGS

SEQ ID NO: 388 - protein, 208 aa, Artificial sequence
  Sulfonylurea responsive repressor L7-4C06
  misc_feature (9)..(9): Xaa can be any naturally occurring amino acid
  misc_feature (19)..(19): Xaa can be any naturally occurring amino acid
MGSRLDKSXVINSALELLXEVGIEGLTTRKLAQKLGVEQPTLYWHVKNKRALLDAMAIEMLDRHATHYCPLEGESWQDFLRNNAKSMRCALLSHRDGAKVCLGTGFTEQQYEAAENSLAFLCQQGFSLENALYAMQAVGIFTLGCVLLDQELQVAKEERETPTTDSMPPLVRQGLELKDHQGAEPAFLFGLELIICGLEKQLKCESGS

SEQ ID NO: 389 - protein, 208 aa, Artificial sequence
  Sulfonylurea responsive repressor L7-4C09
MGSRLDKSKVINSALELLNEVGIEGLTTRKLAQKLGVEQPTLYWHVKNKRALLDAMAIEMLDRHATHYCPLEGESWQDFLRNNAKSMRCALLSHRDGAKVCLGTGFTEQQYESAENSLAFLCQQGFSLENAMYAMQAAGIFTLGCVLLDQELQVAKEERETPTTDSMPPLVRQALELKDHQGAEPAFLFGLELIICGLEKQLKCESGS

SEQ ID NO: 390 - protein, 208 aa, Artificial sequence
  Sulfonylurea responsive repressor L7-4C12
MGSRLDKSKVINSALELLNEVGIEGLTTRKLAQKLGVEQPTLYWHVKNKRALLDAMAIEMLDRHATHFCPLEGESWQDFLRNNAKSMRCALLSHRDGAKVCLGTGFTEQHYESAENSLAFLCQQGFSLENAMYAMQAVGIYTLGCVLLDQELQVAKEERETPTTDSMPPLVRQVLELKDHQGAEPAFLFGLELIICGLEKQLKCESGS

SEQ ID NO: 391 - protein, 208 aa, Artificial sequence
  Sulfonylurea responsive repressor L7-4D04
  misc_feature (6)..(6): Xaa can be any naturally occurring amino acid
MGSRLXKSKVINSALELLNEVGIEGLTTRKLAQKLGVEQPTLYWHVKNKRALLDAMAIEMLDRHATHVCPLEGESWQDFLRNNAKSMRCALLSHRDGAKVCLGTGFTEQQYETAENSLAFLCQQGFSLEHALYAMQAVGIYTLGCVLLDQELQVAKEERETPTTDSMPPLVRQVLELKDHQGAEPAFLFGLELIICGLEKQLKCESGS

SEQ ID NO: 392 - protein, 208 aa, Artificial sequence
  Sulfonylurea responsive repressor L7-4D07
  misc_feature (5)..(7): Xaa can be any naturally occurring amino acid
  misc_feature (9)..(9): Xaa can be any naturally occurring amino acid
MGSRXXXSXVINSALELLNEVGIEGLTTRKLAQKLGVEQPTLYWHVKNKRALLDALAIEMLDRHATHYCPLEGESWQDFLRNNAKSMRCALLSHRDGAKVCLGTGFTEKQYEAAENSMAFLCQQGFSLEHALYAMQAVGIYTLGCVLLDQELQVAKEERETPTTDSMPPLVRQALELKDHQGAEPAFLFGLELIICGLEKQLKCESGS

SEQ ID NO: 393 - protein, 209 aa, Artificial sequence
  Sulfonylurea responsive repressor L7-4D08
  misc_feature (6)..(10): Xaa can be any naturally occurring amino acid
  misc_feature (209)..(209): Xaa can be any naturally occurring amino acid
MGSRLXXXXXINSALELLNEVGIEGLTTRKLAQKLGVEQPTLYWHVKNKRALLDAMAIEMLDRHATHYCPLEGESWQDFLRNNAKSMRCALLSHRDGAKVCLGTGFTEQQYESAENSMAFLCQQGFSLENAMYAMQAAGIFTLGCVLLDQELQVAKEERETPTTDSMPPLLRQVLELKDHQGAEPAFLFGLELIICGLEKQLKCESGSX

SEQ ID NO: 394 - protein, 208 aa, Artificial sequence
  Sulfonylurea responsive repressor L7-4D10
  misc_feature (7)..(7): Xaa can be any naturally occurring amino acid
  misc_feature (9)..(10): Xaa can be any naturally occurring amino acid
  misc_feature (19)..(19): Xaa can be any naturally occurring amino acid
MGSRLDXSXXINSALELLXEVGIEGLTTRKLAQKLGVEQPTLYWHVKNKRALLDAMAIEMLDRHATHFCPLEGESWQDFLRNNAKSMRCALLSHRDGAKVCLGTGFTEQQYEAAENSMAFLCQQGFSLENAMYAMQAVGIFTLGCVLLDQELQVAKEERETPTTDSMPPLVRQVLELKDHQGAEPAFLFGLELIICGLEKQLKCESGS

SEQ ID NO: 395 - protein, 208 aa, Artificial sequence
  Sulfonylurea responsive repressor L7-4D11
  misc_feature (6)..(7): Xaa can be any naturally occurring amino acid
MGSRLXXSKVINSALELLNEVGIEGLTTRKLAQKLGVEQPTLYWHVKNKRALLDAMAIEMLDRHATHYCPLEGESWQDFLRNNAKSMRCALLSHRDGAKVCLGTGFTEQQYETAENSMAFLCQQGFSLEHAMYAMQAVGIYTLGCVLLDQELQVAKEERETPTTDSMPPLLRQVLELKDHQGAEPAFLFGLELIICGLEKQLKCESGS

SEQ ID NO: 396 - protein, 208 aa, Artificial sequence
  Sulfonylurea responsive repressor L7-4E01
MGSRLDKSKVINSALELLNEVGIEGLTTRKLAQKLGVEQPTLYWHVKNKRALLDAMAMEMLDRHATHYCPLEGESWQDFLRNNAKSMRCALLSHRDGAKVCLGTGFTEQQYESAENSMAFLCQQGFSLENALYAMQAVGIYTLGCVLLDQELQVAKEERETPTTDSMPPLVRQGLELKDHQGAEPAFLFGLELIICGLEKQLKCESGS

SEQ ID NO: 397 - protein, 208 aa, Artificial sequence
  Sulfonylurea responsive repressor L7-4E02
  misc_feature (179)..(179): Xaa can be any naturally occurring amino acid
MGSRLDKSKVINSALELLNEVGIEGLTTRKLAQKLGVEQPTLYWHVKNKRALLDALAIEMLDRHATHYCPLEGESWQDFLRNNAKSMRCALLSHRDGAKVCLGTGFTEQQYEAAENSLAFLCQQGFSLEHALYAMQAAGIYTLGCVLLDQELQVAKEERETPTTDSMPPLLRQGLELKXHQGAEPAFLFGLELIICGLEKQLKCESGS

SEQ ID NO: 398 - protein, 208 aa, Artificial sequence
  Sulfonylurea responsive repressor L7-4E04
  misc_feature (5)..(9): Xaa can be any naturally occurring amino acid
MGSRXXXXXVINSALELLNEVGIEGLTTRKLAQKLGVEQPTLYWHVKNKRALLDAMAIEMLDRHATHYCPLEGESWQDFLRNNAKSMRCALLSHRDGAKVCLGTGFTEQQYETAENSLAFLCQQGFSLENAMYAMQAAGIYTLGCVLLDQELQVAKEERETPTTDSMPPLLRQVLELKDHQGAEPAFLFGLELIICGLEKQLKCESGS

SEQ ID NO: 399 - protein, 208 aa, Artificial sequence; identical to SEQ ID NO: 301
  Sulfonylurea responsive repressor L7-4E05

SEQ ID NO: 400 - protein, 208 aa, Artificial sequence
  Sulfonylurea responsive repressor L7-4E07
MGSRLDKSKVINSALELLNEVGIEGLTTRKLAQKLGVEQPTLYWHVKNKRALLDAMAIEMLDRHATHYCPLEGESWQDFLRNNAKSMRCALLSHRDGAKVCLGTGFTEQQYETAENSMAFLCQQGFSLENALYAMQAAGIFTLGCVLLDQELQVAKEERETPTTDSMPPLVRQVLELKDHQGAEPAFLFGLELIICGLEKQLKCESGS

SEQ ID NO: 401 - protein, 208 aa, Artificial sequence
  Sulfonylurea responsive repressor L7-4E08
MGSRLDKSKVINSALELLNEVGIEGLTTRKLAQKLGVEQPTLYWHVKNKRALLDAMAIEMLDRHATHICPLEGESWQDFLRNNAKSMRCALLSHRDGAKVCLGTGFTEQQYETAENSMAFLCQQGFSLENAMYAMQAVCIYTLGCVLLDQELQVAKEERETPTTDSMPPLVRQALELKDHQGAEPAFLFGLELIICGLEKQLKCESGS

SEQ ID NO: 402 - protein, 218 aa, Escherichia coli
  Accession P0ACT4, on plasmid RA1
MARLNRESVIDAALELLNETGIDGLTTRKLAQKLGIEQPTLYWHVKNKRALLDALAVEILARHHDYSLPAAGESWQSFLRNNAMSFRRALLRYRDGAKVHLGTRPDEKQYDTVETQLRFMTENGFSLRDGLYAISAVSHFTLGAVLEQQEHTAALTDRPAAPDENLPPLLREALQIMDSDDGEQAFLHGLESLIRGFEVQLTALLQIVGGDKLIIPFC

SEQ ID NO: 403 - protein, 126 aa, Haemophilus parainfluenzae
MSRLDKSKVINSALELLNEVGIEGLTTRKLAQKLGVEQPTLYWHVKNKRALLDALAIEMLDRHHTHFCPLEGESWQDFLRNNAKSFRCALLSHRDGAKVHLGTRPTEKQYETLENQLAFYANKVFH

SEQ ID NO: 404 - protein, 211 aa, Escherichia coli
MARLSLDDVISMALTLLDSEGLEGLTTRKLAQSLKIEQPTLYWHLRNKQTLMNMLSEAILAKHHTRSAPLPTESWQQFLQENALSFRKALLVHRDGARLHIGTSPTPPQFEQAEAQLRCLCDAGFSVEEALFILQSISHFTLGAVLEEQATNQIENNHVIDAAPPLLQEAFNIQARTSAEMAFHFGLKSLIFGFSAQLDEKKHTPIEDGNK

SEQ ID NO: 405 - protein, 207 aa, Proteus mirabilis
MAKLDKEQVIDNALILLNEVGMEGLTTRKLAQKLGVEQPTLYWHVKNKRALLDALAETILQKHHHHVLPLANESWQDFLRNNAKSFRQALLMYRDGGKIHAGTRPSANQFETSEQQLQFLCDAGFTLTQAVYALSSIAHFTLGSVLETQEHQESQKEREKVPKTEINYPPLLTQAIDIMDSDNGEAAFLFVLDVMISGLETVLNNHH

SEQ ID NO: 406 - protein, 208 aa, Pseudomonas sp.
MTKLDKGTVIAAALELLNEVGMDSLTTRKLAERLKVQQPALYWHFQNKRALLDALAEAMLAERHTRSLPEENEDWRVFLKENALSFRTALLSYRDGARIHAGTRPTEPNFGTAETQIRFLCAEGFCPKRAVWALRAVSHYVVGSVLEQQASDADERVPDRPDVSEQAPSSFLHDLFHELETDGMDAAFNFGLDSLIAGFERLRSSTTD

SEQ ID NO: 407 - protein, 208 aa, Pseudomonas sp.
MTKLDKGTVIAAALELLNEVGMDSLTTRKLAERLRVQQPALYWHFPSKRALLDALAEAMLTERHTRSLPEENEDWRVFLKENALSFRKALLSYRDGARIHAGTRPTEPHYGTAEAQIRFLCTAGFSPKRAVWALWAVSHYVVGSVLEQQASNANDRMSDKSDVSEQAPSSFLHDLFHELETDGMDAPFNFGLDSLIAGFEQLRLSTTD

SEQ ID NO: 408 - protein, 213 aa, Serratia marcescens
MSEKNTAARLTRETVLRGALALLDDIGIDALSTRRLAQHLGVQSPTLYWHFKNKAELLKAMAETIMLDHREEVPADMPWQAWVTANAINFRRALLAYRDGARLHAGTRPQEPQFAIIEAKVALLCRAGFTPEHAVNLLFAVGRFVVGWVLEEQQMQPDDALNEADRRRYPLLCGGWEKLQDKGADALFEAGLRLLVDGAEAALTNANNHGAQS

SEQ ID NO: 409 - protein, 211 aa, Chlamydia suis
MNKLQREAVIRTALELLNDVGMEGLTTRRLAERLGVQQPALYWHFKNKRALLDALAEAMLTINHTHSTPRDDDDWRSFLKGNACSFRRALLAYRDGARIHAGTRPAAPQMEKADAQLRFLCDAGFSAGDATYALMAISYFTVGAVLEQQASEADAEERGEDQLTTSASTMPARLQSAMKIVYEGGPDAAFERGLALIIGGLERSACAISLL

SEQ ID NO: 410 - protein, 213 aa, Acinetobacter sp.
  Accession AAW66496, Acinetobacter sp. LUH5605
MSKKDIAPQRLTREIVLRTALDMLNEEGIDSITTRKLAQRLGIKSPTLYWHFKNKSLLMEAMAETIINEHHLVSLPIDGMTWQDWLLANSVSFRRALLAYRDGARLHARTSPSQGHFNTIEAQVALLSHAGFSPVEAVALLMTLGRFIVGWVLEEQQEEIRSDPPFEADPTIYPLMLQGVNTLQNMNADDIFENGIRMVIIGAERQLDIKMQT

SEQ ID NO: 411 - protein, 211 aa, Laribacter hongkongensis
MTKLQPNTVIRAALDLLNEVGVDGLTTRKLAERLGVQQPALYWHFRNKRALLDALAEAMLAENHTHSVPRADDDWRSFLKGNACSFRRALLAYRDGARIHAGTRPAAPQMEKADAQLRFLCDAGFSAGDATYALMAISYFTVGAVLEQQASEADAEERGEDQLTTSASTMPARLQSAMKIVYEGGPDAAFERGLALIIGGLERSACAISLL

SEQ ID NO: 412 - protein, 168 aa, Salmonella enterica
LYWHFQNKRALLDALAEAMLAERHTRSLPEENEDWRVFLKENALSFRTALLSYRDGARIHAGTRPTEPNFGTAETQIRFLCAEGFCPKRAVWALRAVSHYVVGSVLEQQASDADERVPDRPDVSEQAPSSFLHDLFHELETDGMDAAFNFGLDSLIAGFERLRSSTTD

SEQ ID NO: 413 - protein, 213 aa, Klebsiella pneumoniae
MIKLQPNTVIRVALDLLNEVGVEALTTRKLAKRLGVQQPALYWHFRNKRALLDALAEAMLAENHTHSVPRVDDDWRSFLIGNARSFRQALLAYRDGARIHAGTRPGAPQMEVVDAQLRFLCEAGFSAWDAVNALMTISYFTVGAVLEEQAGDSDAGERGGTIEQAPLLRAVIDTFDEAGPDAVFELGLAVIVDGLAKRRLVARNIQGPRKGDD

SEQ ID NO: 414 - protein, 216 aa, Unknown
  Accession CAA24908, unidentified bacterium
MTKLQPNTVIRAALDLLNEVGVDGLTTRKLAERLGVQQPALYWHFRNKRALLDALAEAMLAENHSTSVPRADDDWRSFLTGNARSFRQALLAYRDGARIHAGTRPGAPQMETADAQLRFLCEAGFSAGDAVNALMTISYFTVGAVLEEQAGDSESGERGGTVEQAPLSPLLRAAIDAFDEAGPDAAFEQGLAVIVDGLAKRRLVVRNVEGPRKGDD

SEQ ID NO: 415 - protein, 210 aa, Yersinia pestis
  Accession CAC80726, Yersinia pestis CO92
MMARLDKKRVIESALALLDEVGMEGLTTRKLAQKLNIEQPSLYWHVKNKRALLDALSVEILLRHHDHFQPQKGEYWADFLRENAKSFRRALLSHRDAAKIHLGTRPSPEQFETVEAQLAFLCEQGFSLEEALYTLGVVSHFTLGSVLEEREYLEAMRDDDPAIHAAMPPLLTKALEIMEQDTGEKPFLFGLEVIILGLEAKQKQKKGNQE

SEQ ID NO: 416 - protein, 210 aa, Aliivibrio salmonicida
MARLSLDDVISMALTLLDREGLEGLTTRNVAQSLKIEQPTLYWHVRNKQTLMNMLSEAILAKHHTRSVPLPTESWQQFLQENALSFRKALLVHRDGARLHIGTSPTPPQFEQAEAQLRCLCDAGFSVEEALFILQSISHFTLGAVLEEQATNPTEYNTVMDAVPPLLQEAFNVQTRTTAETAFHFGLRSLIVGFSAQLDEKYMSIQGNNK

SEQ ID NO: 417 - protein, 213 aa, Burkholderia cenocepacia
  Accession EAY62734, Burkholderia cenocepacia PC184
MIEMKDTGARLTRDTVLRAALNLLDEVGIDGLSTRRLAERLGVQSPTLYWHFRNKAELLDAMAEAIMLERHGESLPRPGDVWDVWLAENARSFRRALLAYRDGARLHAGTRPRALHFSSIERKVALLGEAGFKPDEAVDVMVAIGRFVVGWVLEEQARPDGDADALLPDAAEYPLFAKGWAALRERSGDEAFERGIAWIVDGARARLAARRAG

SEQ ID NO: 418 - protein, 226 aa, Aeromonas salmonicida
MKKLQREAVIRTALELLNDVGMEGLTTRRLAERLGVQQPALYWHFRNKRALLDALAEAMLTINHTHSTPRDEDDWRSFLKGNACSFRRALLAYRDGARIHAGTRPAAPQMEKADAQLRFLCDAGFLAGDATYALMAISYFTVGAVLEQQASEADAEERGEDQLTTSASTMPARLQSAMKIVYEGGPDAAFERGLALIIGGLEQVRLSPASSPAGRTNLVLALAAGS

SEQ ID NO: 419 - protein, 226 aa, Aeromonas salmonicida
MNKLQREAVIRTALELLNDVGMEGLTTRRLAERLGVQQPALYWHFKNKRALLDALAEAMLTINHTHSTPRDDDDWRSFLKGNACSFRRALLAYRDGARIHAGTRSAAPQMEKADAQLRFLCDAGFSAGDATYALMAISYFTVGAVLEQQASEADAEERGEDQLTTSASTMPARLQSAMKIVYEGGPDAAFERGLALIIGGLEQVRLSPASSPAGRTNLVLALAAGS

SEQ ID NO: 420 - protein, 219 aa, Salmonella typhimurium
  Accession NP_511232, IncN plasmid R46
MNKLQREAVIRTALELLNDVGMEGLTTRRLAERLGVQQPALYWHFKNKRALLDALAEAMLTINHTHSTPRDDDDWRSFLKGNACSFRRALLAYRDGARIHAGTRPAAPQMEKADAQLRFLCDAGFSAGDATYALMAISYFTVGAVLEQQASEADAEERGEDQLTTSASTMPARLQSAMKIVYEGGPDAAFERGLALIIGGLEKMRLTTNDIEVLKNVDE

SEQ ID NO: 421 - protein, 216 aa, Streptomyces avermitilis
  Accession NP_824556, Streptomyces avermitilis MA-4680
MVTQRSPKLDKKQVVETALRLLNEAGLDGLTLRAIAKELNVQAPALYWHFKNKQALLDEMATEMYRRMTEGAHLAPGASWQERLLHGNRALRTALLGYRDGAKVFSGSRFTGTEHAVQLEASLRSLVEAGFDLPQAVRATSTAYFFTLGFVTEEQGVEPLPGERREGYDVDERAARMADFPLAAAAGAEIFQNYEEGFEEGLRLVIAGIEARYGIR

SEQ ID NO: 422 - protein, 210 aa, Listonella anguillarum
MTKLDKGTVIAAGLELLNEVGMDSLTTRKLAERLKVQQPALYWHFQNKRALLDALPEAMLRERHTRSLPEENEDWRVFLKENALSFRTALLSYRDGARIHAGTRPTEPNFGTAETQIRFLCAEGFCPKRAVWALRAVSHYVVGSVLEQQASDADERVPDRPDVSEQAPSSFLHVLFHELETDGMDAAFNFGLDSLIAGFERLRAAVLATD

SEQ ID NO: 423 - protein, 207 aa, Aeromonas bestiarum
MTKLDRETVIQAALELLNEVGVDNLTTRKLAERLKVQQPALYWHFRNKRALLDALSEAMLEKNHTRTVPQTGEDWRVFLKENALSFRSALLSYRDGARIHAGTRPTSAQYERVEKQIRFLCESGFEQPDAVRALVIVSHYTTGSVSEQQAALEDSSERKQASKEAPAQPSQFLSHAFDTFDAEGADFAFEYGLDALISGLEMKKATK

SEQ ID NO: 424 - protein, 206 aa, Ochrobactrum anthropi
  Accession YP_001370475, ATCC 49188
MVSALAKLHRDAVIQTALELLNEVGEEGLTTRRLAERLGVQQPALYWHFKNKRVLLDALAETILAEHHDHALPRAGENWRHFLIENAHSFRRALLTYRDGAHIHAGTRPNNNQAGQAETQIEFLIQAGFTPANAARALIAISHYVVGSALEQQADIHESVPGDAVSITATSEIAQAIAILDADGAENLFDFGLMLLVDGLERHRQS

SEQ ID NO: 425 - protein, 210 aa, Burkholderia sp.
  Accession YP_368094, Burkholderia sp. 383
MKDTGARLTRDTVLRAALELLDEVGIDGLSTRKLAERLGVQSPTLYWHFRNKGELLDAMAEAIMLERHDASLPRPGEAWDAWLLDNARSFRRALLAYRDGARLHAGTRPRALHFSSIERKVALLGDAGFAPDEAVDVMYALGRFVVGWVLEEQAESSDEAAAPLPDAAEYPLLAKGWAALRGRSGDDAFERGVAWIVDGARARLAARERG

SEQ ID NO: 426 - protein, 210 aa, Burkholderia cenocepacia
  Accession YP_620166, Burkholderia cenocepacia AU 1054
MKDTGTRLTRDTVLRAALNLLDEVGIDGLSTRRLAERLGVQSPTLYWHFRNKAELLDAMAEAIMLERHGESLPRPGDVWDVWLAENARSFRRALLAYRDGARLHAGTRPRALHFSSIERKVALLGEAGFKPDEAVDVMVAIGRFVVGWVLEEQARPDGDTDALLPDAAEYPLFAQGWAALRERSGDEAFERGIAWIVDGARARLAARRAG

SEQ ID NO: 427 - protein, 211 aa, Burkholderia ambifaria
  Accession YP_772551, Burkholderia ambifaria AMMD
MKDTSTRLTRDTVMRAALDLLNEVGIDGLSTRRLAERLGVQSPTLYWHFRNKAELLDAMAEAIMLERHGASLPRPGDTWDAWLLENARGFRRALLAYRDGARLHAGTRPRTLHFDSIERKVALLADAGFAPDEAVDVMYALGRFVVGWVLEEQAEAERETDTTLPDTAEHPLLAQGWTALRERGGDEAFERGVALIVDGARARLAARQRGG

SEQ ID NO: 428 - protein, 207 aa, Haemophilus somnus
  Accession ZP_00132379, Haemophilus somnus 2336
MAKLDKEQVIDNALILLNEVGIEGLTTRKLAQKIGVEQPTLYWHVKNKRALLDALAETILQKHHHHVLPLPNETWQDFLRNNAKSFRQALLMYRDGGKIHAGTRPSESQFETSEQQLQFLCDAGFSLSQAVYALSSIAHFTLGSVLETQEHQESQKEREKVETDTVAYPPLLTQAVAIMDSDNGDAAFLFVLDVMISGLETVLKSAK

SEQ ID NO: 429 - protein, 211 aa, Burkholderia ambifaria
  Accession ZP_01558383, Burkholderia ambifaria MC40-6
MKDTGARLTRDTVMRAALDLLNEVGIDGLSTRRLAERLGVQSPTLYWHFRNKAELLDAMAEAIMLERHGASLPRPGDAWDAWLLENARSFRRALLAYRDGARLHAGTRPRTLHFGSIERKVALLAEAGFAPDEAVDVMYALGRFVVGWVLEEQAEAERETDTTLPDTAEHPLLAQGWAALRERGGDEAFERGVALIVDGARARLAARRRGG

SEQ ID NO: 430 - protein, 203 aa, Burkholderia cenocepacia
  Accession ZP_01567051, Burkholderia cenocepacia MC0-3
MAKIRRDEIVDAALALLDEQGLDALTTRRLAQRLGVESAALYWHYRDKSVLLAEMAAVALARHHTLDVPADTAQWDAWFADNARSFRRALLAHRDGARLHAGSTPDLDAVERIRPKIAYLVRAGLTEQEAGMAMLAAGQFTIGCVLEQQAAQGRGAEEPARRDAADDRPRTSGAALAPIDPGVAFEFGLGLIVDGLRRRVDRA

SEQ ID NO: 431 - protein, 216 aa, Escherichia coli
MTKLQPNTVIRAALDLLNEVGVDGLTTRKLAERLGVQQPALYWHFRNKRALLDALAEAMLAENHTHSVPRADDDWRSFLIGNARSFRQALLAYRDGARIHAGTRPGAPQMETADAQLRFLCEAGFSAGDAVNALMTISYFTVGAVLEEQAGDSDAGERGGTVEQAPLSPLLRAAIDAFDEAGPDAAFEQGLAVIVDGLAKRRLVVRNVEGPRKGDD

SEQ ID NO: 432 - protein, 211 aa, Escherichia coli
MARLSLDDVISMALTLLDSEGLEGLTTRKLAQSLKIEQPTLYWHVRNKQTLMNMLSEAILAKHHTRSAPLPTESWQQFLQENALSFRKALLVHRDGARLHIGTSPTPPQFEQAEAQLRCLCDAGFSVEEALFILQSISHFTLGAVLEEQATNQIENNHVIDAAPPLLQEAFNIQARTSAEMAFHFGLKSLIFGFSAQLDEKKHTPIEDGNK

SEQ ID NO: 433 - protein, 207 aa, Pasteurella multocida
MAKLDKEQVIDDALILLNEVGIEGLTTRNVAQKIGVEQPTLYWHVKNKRALLDALAETILQKHHHHVLPLPNETWQDFLRNNAKSFRQALLMYRDGGKIHAGTRPSESQFETSEQQLQFLCDAGFSLSQAVYALSSIAHFTLGSVLETQEHQESQKEREKVETDTVAYPPLLTQAVAIMDSDNGDAAFLFVLDVMISGLETVLKSAK

SEQ ID NO: 434 - DNA, 627 bp, Artificial sequence
  SuR L1-02 CDS
atgggatctagattagataaaagtaaagtgattaacagcgcattagagctgcttaatgaggtcggaatcgaaggtttaacaacccgtaaactcgcccagaagctaggtgtagagcagcctacattgtattggcatgtaaaaaataagcgagctctgctcgacgccttagccattgagatgctggataggcacgcgactcacttttgccctttagaaggggaaagctggcaagattttttacgtaataacgctaaaagttttagatgtgctttactaagtcatcgcgatggagcaaaagtatgtttaggtacagcggtgacagaaaaacagtatgaaactatggaaaatattttagcctttttatgccaacaaggtttttcactagagaatgcattatatgcaaggcgcgctgtgattgcgtttactttaggttgcgtattgtgggatcaagagtatcaagtcgctaaagaagaaagggaaacacctactactgatagtatgccgccattattacgacaagctagggaattaattgatcaccaaggtgcagagccagccttcttattcggccttgaattgatcatatgcggattagaaaaacaacttaaatgtgaaagtgggtcttaa

SEQ ID NO: 435 - DNA, 627 bp, Artificial sequence
  SuR L1-07 CDS
atgggatctagattagataaaagtaaagtgattaacagcgcattagagctgcttaatgaggtcggaatcgaaggtttaacaacccgtaaactcgcccagaagctaggtgtagagcagcctacattgtattggcatgtaaaaaataagcgagctctgctcgacgccttagccattgagatgctggataggcacaatactcacttttgccctttagaaggggaaagctggcaagattttttacgtaataacgctaaaagttggagatgtgctttactaagtcatcgcgatggagcaaaagtagtgttaggtacagcgattacagaaaaacagtatgaaactcacgaaaatccgttagcctttttatgccaacaaggtttttcactagagaatgcattatatgcaatcgccgctgtgcgtaggtttactttaggttgcgtattggtggatcaagagcggcaagtcgctaaagaagaaagggaaacacctactactgatagtatgccgccattattacgacaagctagtgaattacaggatcaccaaggtgcagagccagccttcttattcggccttgaattgatcatatgcggattagaaaaacaacttaaatgtgaaagagggtcttaa

SEQ ID NO: 436 - DNA, 627 bp, Artificial sequence
  SuR L1-09 CDS
atgggatctagattagataaaagtaaagtgattaacagcgcattagagctgcttaatgaggtcggaatcgaaggtttaacaacccgtaaactcgcccagaagctaggtgtagagcagcctacattgtattggcatgtaaaaaataagcgagctctgctcgacgccttagccattgagatgctggataggcacgcgactcacttttgccctttagaaggggaaagctggcaagattttttacgtaataacgctaaaagtatgagatgtgctttactaagtcatcgcgatggagcaaaagtatgtttaggtacaggctttacagaaaaacagtatgaaactgccgaaaatagtttagcctttttatgccaacaaggtttttcactagagaatgcattatatgcaatgcaggctgtgtgtatttttactttaggttgcgtattgttggatcaagagcttcaagtcgctaaagaagaaagggaaacacctactactgatagtatgccgccattattacgacaagctctggaattaaaggatcaccaaggtgcagagccagccttcttattcggccttgaattgatcatatgcggattagaaaaacaacttaaatgtgaaagtgggtcttaa

SEQ ID NO: 437 - DNA, 627 bp, Artificial sequence
  SuR L1-20 CDS
atgggatctagattagataaaagtaaagtgattaacagcgcattagagctgcttaatgaggtcggaatcgaaggtttaacaacccgtaaactcgcccagaagctaggtgtagagcagcctacattgtattggcatgtaaaaaataagcgagctctgctcgacgccttagccattgagatgatggataggcaccagactcacttttgccctttagaaggggaaagctggcaagattttttacgtaataacgctaaaagtatgagatgtgctttactaagtcatcgcgatggagcaaaagtatttttaggtacagcgtggacagaaaaacagtatgaaactgtggaaaatctgttagcctttttatgccaacaaggtttttcactagagaatgcattatatgcactcaatgctgtggcgacgtttactttaggttgcgtattgtgggatcaagagaagcaagtcgctaaagaagaaagggaaacacctactactgatagtatgccgccattattacgacaagctcatgaattaggtgatcaccaaggtgcagagccagccttcttattcggccttgaattgatcatatgcggattagaaaaacaacttaaatctgaaagtgggtcttaa

SEQ ID NO: 438 - DNA, 627 bp, Artificial sequence
  SuR L1-22 CDS
atgggatctagattagataaaagtaaagtgattaacagcgcattagagctgcttaatgaggtcggaatcgaaggtttaacaacccgtaaactcgcccagaagctaggtgtagagcagcctacattgtattggcatgtaaaaaataagcgagctctgctcgacgccttagccattgagatgatggataggcaccatactcacttttgccctttagaaggggaaagctggcaagattttttacgtaatactgctaaaagttatcgatgtgctttactaagtcatcgcgatggagcaaaagtatgtttaggtacagcgattacagaaaaacagtatgaaactaaggaaaataatttagcctttttatgccaacaaggtttttcactagagaatgcattatatgcacggcaggctgtgcgggtgtttactttaggttgcgtattgtttgatcaagagatgcaagtcgctaaagaagaaagggaaacacctactactgatagtatgccgccattattacgacaagcttcggaattactggatcaccaaggtgcagagccagccttcttattcggccttgaattgatcatatgcggattagaaaaacaacttaaatctgaaagtgggtcttaa

SEQ ID NO: 439 - DNA, 627 bp, Artificial sequence
  SuR L1-24 CDS
atgggatctagattagataaaagtaaagtgattaacagcgcattagagctgcttaatgaggtcggaatcgaaggtttaacaacccgtaaactcgcccagaagctaggtgtagagcagcctacattgtattggcatgtaaaaaataagcgagctctgctcgacgccttagccattgagatgctggataggcacaatactcacttttgccctttagaaggggaaagctggcaagattttttacgtaattctgctaaaagtatgagatgtgctttactaagtcatcgcgatggagcaaaagtattgttaggtacagcggtgacagaaaaacagtatgaaactacggaaaattctttagcctttttatgccaacaaggtttttcactagagaatgcattatatgcaatccgcgctgtgcgtacgtttactttaggttgcgtattggtggatcaagagcggcaagtcgctaaagaagaaagggaaacacctactactgatagtatgccgccattattacgacaagctaaggaattattggatcaccaaggtgcagagccagccttcttattcggccttgaattgatcatatgcggattagaaaaacaacttaaatgtgaaagtgggtcttaa

SEQ ID NO: 440 - DNA, 627 bp, Artificial sequence
  SuR L1-28 CDS
atgggatctagattagataaaagtaaagtgattaacagcgcattagagctgcttaatgaggtcggaatcgaaggtttaacaacccgtaaactcgcccagaagctaggtgtagagcagcctacattgtattggcatgtaaaaaataagcgagctctgctcgacgccttagccattgagatgctggataggcacgcgactcacttttgccctttagaaggggaaagctggcaagattttttacgtaataacgctaaaagtatgagatgtgctttactaagtcatcgcgatggagcaaaagtatggttaggtacagcgtggacagaaaaacagtatgaaactcccgaaaatgtgttagcctttttatgccaacaaggtttttcactagagaatgcattatatgcatcgcgcgctgtggtaacttttactttaggttgcgtattgactgatcaagagaagcaagtcgctaaagaagaaagggaaacacctactactgatagtatgccgccattattacgacaagcttgggaattacttgatcaccaaggtgcagagccagccttcttattcggccttgaattgatcatatgcggattagaaaaacaacttaaatgtgaaagtgggtcttaa

SEQ ID NO: 441 - DNA, 627 bp, Artificial sequence
  SuR L1-29 CDS
atgggatctagattagataaaagtaaagtgattaacagcgcattagagctgcttaatgaggtcggaatcgaaggtttaacaacccgtaaactcgcccagaagctaggtgtagagcagcctacattgtattggcatgtaaaaaataagcgagctctgctcgacgccttagccattgagatgatggataggcaccagactcacttttgccctttagaaggggaaagctggcaagattttttacgtaatactgctaaaagtatgagatgtgctttactaagtcatcgcgatggagcaaaagtatggttaggtacacgctggacagaaaaacagtatgaaactcccgaaaatatgttagcctttttatgccaacaaggtttttcactagagaatgcattatatgcatggagcgctgtgtgtaattttactttaggttgcgtattgtcggatcaagagaggcaagtcgctaaagaagaaagggaaacacctactactgatagtatgccgccattattacgacaagcttgggaattatctgatcaccaaggtgcagagccagccttcttattcggccttgaattgatcatatgcggattagaaaaacaacttaaatgtgaaagtgggtcttaa

SEQ ID NO: 442 - DNA, 627 bp, Artificial sequence
  SuR L1-31 CDS
atgggatctagattagataaaagtaaagtgattaacagcgcattagagctgcttaatgaggtcggaatcgaaggtttaacaacccgtaaactcgcccagaagctaggtgtagagcagcctacattgtattggcatgtaaaaaataagcgagctctgctcgacgccttagccattgagatgctggataggcacgcgactcacttttgccctttagaaggggaaagctggcaagattttttacgtaataacgctaaaagtatgagatgtgctttactaagtcatcgcgatggagcaaaagtaatgttaggtacacgcgctacagaaaaacagtatgaaactgtggaaaatcgtttagcctttttatgccaacaaggtttttcactagagaatgcattatatgcagtgcgcgctgtgcattggtttactttaggttgcgtattgattgatcaagagatgcaagtcgctaaagaagaaagggaaacacctactactgatagtatgccgccattattacgacaagcttatgaattatatgatcaccaaggtgcagagccagccttcttattcggccttgaattgatcatatgcggattagaaaaacaacttaaatgtgaaagtgggtcttaa

SEQ ID NO: 443 - DNA, 627 bp, Artificial sequence
  SuR L1-38 CDS
atgggatctagattagataaaagtaaagtgattaacagcgcattagagctgcttaatgaggtcggaatcgaaggtttaacaacccgtaaactcgcccagaagctaggtgtagagcagcctacattgtattggcatgtaaaaaataagcgagctctgctcgacgccttagccattgagatggcggataggcaccatactcacttttgccctttagaaggggaaagctggcaagattttttacgtaataacgctaaaagtatgagatgtgctttactaagtcatcgcgatggagcaaaagtatggttaggtacagcgtggacagaaaaacagtatgaaactaccgaaaatatgttagcctttttatgccaacaaggtttttcactagagaatgcattatatgcatggcgcgctgtgacgatgtttactttaggttgcgtattgcgtgatcaagagtggcaagtcgctaaagaagaaagggaaacacctactactgatagtatgccgccattattacgacaagctttggaattaggtgatcaccaaggtgcagagccagccttcttattcggccttgaattgatcatatgcggattagaaaaacaacttaaatgtgaaagtgggtcttaa

SEQ ID NO: 444 - DNA, 627 bp, Artificial sequence
  SuR L1-44 CDS
atgggatctagattagataaaagtaaagtgattaacagcgcattagagctgcttaatgaggtcggaatcgaaggtttaacaacccgtaaactcgcccagaagctaggtgtagagcagcctacattgtattggcatgtaaaaaataagcgagctctgctcgacgccttagccattgagatgctggataggcacgcgactcacttttgccctttagaaggggaaagctggcaagattttttacgtaataacgctaaaagttatagatgtgctttactaagtcatcgcgatggagcaaaagtatatttaggtacagcggtgacagaaaaacagtatgaaactgccgaaaatcagttagcctttttatgccaacaaggtttttcactagagaatgcattatatgcagtgaaggctgtggcggggtttactttaggttgcgtattgtgggatcaagagtctcaagtcgctaaagaagaaagggaaacacctactactgctagtatgccgccattattacgacaagctgtggaattagcggatcaccaaggtgcagagccagccttcttattcggccttgaattgatcatatgcggattagaaaaacaacttaaatgtgaaagtgggtcttaa

SEQ ID NO: 445 - DNA, 627 bp, Artificial sequence
  SuR L6-1B03 CDS
atgggatctagattagataaaagtaaagtgattaacagcgcattagagctgcttaatgaggtcggaatcgaaggtttaacaacccgtaaactcgcccagaagctaggtgtagagcagcctacattgtattggcatgtaaaaaataagcgagctctgctcgacgccttagccattgagatgatggataggcacgcaactcacatttgccctttagaaggggaaagctggcaagattttttacgtaataatgctaaaagtatgagatgtgctttactaagccatcgcgatggagcaaaagtatgtttaggtacacgctggacagaacaacaatatgaagctgctgaaaatatgttagcctttttatgccaacaaggtttttcactagagaatgcattatatgcagtgagtgctgtgagggtgtttactttaggttgcgtattgtttgatcaagagagccaagtcgctaaagaagaaagggaaacacctactactgctagtatgccgccattattgcgacaagcttgggaattaaaggatcaccaaggtgcagagccagccttcttattcggccttgaattgatcatatgcggattagaaaaacaacttaaatgcgaaagtgggtcttaa

SEQ ID NO: 446 - DNA, 627 bp, Artificial sequence
  SuR L6-1C03 CDS
  misc_feature (240)..(240): n is a, c, g, or t
  misc_feature (427)..(427): n is a, c, g, or t
atgggatctagattagataaaagtaaagtgattaacagcgcattagagctgcttaatgaggtcggaatcgaaggtttaacaacccgtaaactcgcccagaagctaggtgtagagcagcctacattgtattggcatgtaaaaaataagcgagctctgctcgacgccttagccattgagatgatggataggcaccaaactcactattgccctttagaaggggaaagctggcaagattttttncgtaataatgctaaaagtatgagatgtgctttactaagccatcgcgatggagcaaaagtatgtttaggtacacgctggacagaacaacaatatgaaagtgctgaaaatatgttagcctttttatgccaacaaggtttttcactagagaatgcattatatgcaatgagtgctgtgagggtgtttactntaggttgcgtattgtttgatcaagagagccaagtcgctaaagaagaaagggaaacacctactactgctagtatgccgccattattgcgacaagcttgggaattaaaggatcaccaaggtgcagagccagccttcttattcggccttgaattgatcatatgcggattagaaaaacaacttaaatgcgaaagtgggtcttaa

SEQ ID NO: 447 - DNA, 627 bp, Artificial sequence
  SuR L6-1C06 CDS
atgggatctagattagataaaagtaaagtgattaacagcgcattagagctgcttaatgaggtcggaatcgaaggtttaacaacccgtaaactcgcccagaagctaggtgtagagcagcctacattgtattggcatgtaaaaaataagcgagctctgctcgacgccttagccattgagatgatggataggcaccaaactcacttttgccctttagaaggggaaagctggcaagattttttacgtaataatgctaaaagtatgagatgtgctttactaagccatcgcgatggagcaaaagtatgtttaggtacacgctggacagaaaaacaatatgaaactgctgaaaatatgttagcctttttatgccaacaaggtttttcactagagaatgcattatatgcaatgagtgctgtgagggtgtttactttaggttgcgtattgtttgatcaagagctccaagtcgctaaagaagaaagggaaacacctactactgctagtatgccgccattagtgcgacaagtttgggaattaaaggatcaccaaggtgcagagccagccttcttattcggccttgaattgatcatatgcggattagaaaaacaacttaaatgcgaaagtgggtcttaa

SEQ ID NO: 448 - DNA, 627 bp, Artificial sequence
  SuR L6-1G06 CDS
atgggatctagattagataaaagtaaagtgattaacagcgcattagagctgcttaatgaggtcggaatcgaaggtttaacaacccgtaaactcgcccagaagctaggtgtagagcagcctacattgtattggcatgtaaaaaataagcgagctctgctcgacgccttagccattgagatgatggataggcacgcaactcactattgccctttagaaggggaaagctggcaagattttttacgtaataatgctaaaagtatgagatgtgctttactaagccatcgcgatggagcaaaagtatgtttaggtacacgctggacagaaaaacattatgaaactgctgaaaatatgttagcctttttatgccaacaaggtttttcactagagaatgcattatatgcagtgagtgctgtgagggtgtttactttaggttgcgtattgtttgatcaagagagccaagtcgctaaagaagaaagggaaacacctactactgctagtatgccgccattattgcgacaagcttgggaattaaaggatcaccaaggtgcagagccagccttcttattcggccttgaattgatcatatgcggattagaaaaacaacttaaatgcgaaagtgggtcttaa

SEQ ID NO: 449 - DNA, 627 bp, Artificial sequence
  SuR L6-1G07 CDS
atgggatctagattagataaaagtaaagtgattaacagcgcattagagctgcttaatgaggtcggaatcgaaggtttaacaacccgtaaactcgcccagaagctaggtgtagagcagcctacattgtattggcatgtaaaaaataagcgagctctgctcgacgccttagccattgagatgatggataggcacgcaactcactattgccctttagaaggggaaagctggcaagattttttacgtaatactgctaaaagtatgagatgtgctttactaagccatcgcgatggagcaaaagtatgtttaggtacacgctggacagaacaacaatatgaaagtgctgaaaatatgttagcctttttatgccaacaaggtttttcactagagaatgcattatatgcagtgagtgctgtgagggtgtttactttaggttgcgtattgtttgatcaagagagccaagtcgctaaagaagaaagggaaacacctactactgctagtatgccgccattagtgcgacaaggttgggaattaaaggatcaccaaggtgcagagccagccttcttattcggccttgaattgatcatatgcggattagaaaaacaacttaaatgcgaaagtgggtcttaa

SEQ ID NO: 450 - DNA, 627 bp, Artificial sequence
  SuR L6-1G09 CDS
atgggatctagattagataaaagtaaagtgattaacagcgcattagagctgcttaatgaggtcggaatcgaaggtttaacaacccgtaaactcgcccagaagctaggtgtagagcagcctacattgtattggcatgtaaaaaataagcgagctctgctcgacgccttagccattgagatgatggataggcaccaaactcactattgccctttagaaggggaaagctggcaagattttttacgtaataatgctaaaagtatgagatgtgctttactaagccatcgcgatggagcaaaagtatgtttaggtacacgctggacagaacaattgtatgaaactgctgaaaatatgttagcctttttatgccaacaaggtttttcactagagaatgcattatatgcagtgagtgctgtgagggtgtttactttaggttgcgtattgtttgatcaagagctccaagtcgctaaagaagaaagggaaacccctactactgctagtatgccgccattattgcgacaagcttgggaattaaaggatcaccaaggtgcagagccagccttcttattcggccttgaattgatcatatgcggattagaaaaacaacttaaatgcgaaagtgggtcttaa

SEQ ID NO: 451 - DNA, 627 bp, Artificial sequence
  SuR L6-1G10 CDS
atgggatctagattagataaaagtaaagtgattaacagcgcattagagctgcttaatgaggtcggaatcgaaggtttaacaacccgtaaactcgcccagaagctaggtgtagagcagcctacattgtattggcatgtaaaaaataagcgagctctgctcgacgccttagccattgagatgatggataggcacgcaactcactattgccctttagaaggggaaagctggcaagattttttacgtaataatgctaaaagtatgagatgtgctttactaagccatcgcgatggagcaaaagtatgtttaggtacacgctggacagaacaacaatatgaaactgctgaaaatatgttagcctttttatgccaacaaggtttttcactagagaatgcattatatgcaatgagtgctgtgagggtgtttactttaggttgcgtattgtttgatcaagagagccaagtcgctaaagaagaaagggaaacacctactactgctagtatgccgccattattgcgacaagtttgggaattaaaggatcaccaaggtgcagagccagccttcttattcggccttgaattgatcatatgcggattagaaaaacaacttaaatgcgaaagtgggtcttaa

SEQ ID NO: 452 - DNA, 627 bp, Artificial sequence
  SuR L6-1G11 CDS
atgggatctagattagataaaagtaaagtgattaacagcgcattagagctgcttaatgaggtcggaatcgaaggtttaacaacccgtaaactcgcccagaagctaggtgtagagcagcctacattgtattggcatgtaaaaaataagcgagctctgctcgacgccttagccattgagatgatggataggcaccaaactcacgtttgccctttagaaggggaaagctggcaagattttttacgtaataatgctaaaagtatgagatgtgctttactaagccatcgcgatggagcaaaagtatgtttaggtacacgctggacagaacaattgtatgaaactgctgaaaatcaattagcctttttatgccaacaaggtttttcactagagaatgcattatatgcaatgagtgctgtgagggtgtttactttaggttgcgtattgtttgatcaagagctccaagtcgctaaagaagaaagggaaacacctactactgctagtatgccaccattattgcgacaagtttgggaattaaaggatcaccaaggtgcagagccagccttcttattcggccttgaattgatcatatgcggattagaaaaacaacttaaatgcgaaagtgggtcttaa

SEQ ID NO: 453 - DNA, 627 bp, Artificial sequence
  SuR L6-1H12 CDS
atgggatctagattagataaaagtaaagtgattaacagcgcattagagctgcttaatgaggtcggaatcgaaggtttaacaacccgtaaactcgcccagaagctaggtgtagagcagcctacattgtattggcatgtaaaaaataagcgagctctgctcgacgccttagccattgagatgatggataggcaccaaactcacatttgccctttagaaggggaaagctggcaagattttttacgtaatactgctaaaagtatgagatgtgctttactaagccatcgcgatggagcaaaagtatgtttaggtacacgctggacagaacaacattatgaaactgctgaaaatcaattagcctttttatgccaacaaggtttttcactagagaatgcattatatgcaatgagtgctgtgagggtgtttactttaggttgcgtattgtttgatcaagagagccaagtcgctaaagaagaaagggaaacacctactactgctagtatgccgccattagtgcgacaagcttgggaattaaaggatcaccaaggtgcagagccagccttcttattcggccttgaattgatcatatgcggattagaaaaacaacttaaatgcgaaagtgggtcttaa

SEQ ID NO: 454 - DNA, 627 bp, Artificial sequence
  SuR L6-2A01 CDS
atgggatctagattagataaaagtaaagtgattaacagcgcattagagctgcttaatgaggtcggaatcgaaggtttaacaacccgtaaactcgcccagaagctaggtgtagagcagcctacattgtattggcatgtaaaaaataagcgagctctgctcgacgccttagccattgagatgatggataggcaccaaactcacgtgtgccctttagaaggggaaagctggcaagattttttacgtaataatgctaaaagtatgagatgtgctttactaagccatcgcgatggagcaaaagtatgtttaggtacacgctggacagaaaaacaatatgaagctgctgaaaatatgttagcctttttatgccaacaaggtttttcactagagaatgcattatatgcagtgagtgctgtgagggtgtttactttaggttgcgtattgtttgatcaagagagccaagtcgctaaagaagaaagggaaacacctactactgctagtatgccgccattattgcgacaaggttgggaattaaaggatcaccaaggtgcagagccagccttcttattcggccttgaattgatcatatgcggattagaaaaacaacttaaatgcgaaagtgggtcttaa

SEQ ID NO: 455 - DNA, 627 bp, Artificial sequence
  SuR L6-2A02 CDS
atgggatctagattagataaaagtaaagtgattaacagcgcattagagctgcttaatgaggtcggaatcgaaggtttaacaacccgtaaactcgcccagaagctaggtgtagagcagcctacattgtattggcatgtaaaaaataagcgagctctgctcgacgccttagccattgagatgatggataggcaccaaactcactattgccctttagaaggggaaagctggcaagattttttacgtaatactgctaaaagtatgagatgtgctttactaagccatcgcgatggagcaaaagtatgtttaggtacacgctggacagaacaacattatgaaactgctgaaaatatgttagcctttttatgccaacaaggtttttcactagagaatgcattatatgcaatgagtgctgtgagggtgtttactttaggttgcgtattgtttgatcaagagctccaagtcgctaaagaagaaagggaaacacctactactgctagtatgccgccattagtgcgacaagtttgggaattaaaggatcaccaaggtgcagagccagccttcttattcggccttgaattgatcatatgcggattagaaaaacaacttaaatgcgaaagtgggtcttaa

SEQ ID NO: 456 - DNA, 627 bp, Artificial sequence
  SuR L6-2A04 CDS
atgggatctagattagataaaagtaaagtgattaacagcgcattagagctgcttaatgaggtcggaatcgaaggtttaacaacccgtaaactcgcccagaagctaggtgtagagcagcctacattgtattggcatgtaaaaaataagcgagctctgctcgacgccttagccattgagatgatggataggcaccaaactcacgtgtgccctttagaaggggaaagctggcaagattttttacgtaataatgctaaaagtatgagatgtgctttactaagccatcgcgatggagcaaaagtatgtttaggtacacgctggacagaacaattgtatgaaactgctgaaaatcaattagcctttttatgccaacaaggtttttcactagagaatgcattatatgcaatgagtgctgtgaggaactttactttaggttgcgtattgtttgatcaagagagccaagtcgctaaagaagaaagggaaacacctactactgctagtatgccgccattagtgcgacaagcttgggaattaaaggatcaccaaggtgcagagccagccttcttattcggccttgaattgatcatatgcggattagaaaaacaacttaaatgcgaaagtgggtcttaa

SEQ ID NO: 457 - DNA, 627 bp, Artificial sequence
  SuR L6-2A06 CDS
atgggatctagattagataaaagtaaagtgattaacagcgcattagagctgcttaatgaggtcggaatcgaaggtttaacaacccgtaaactcgcccagaagctaggtgtagagcagcctacattgtattggcatgtaaaaaataagcgagctctgctcgacgccttagccattgagatgatggataggcaccaaactcactattgccctttagaaggggaaagctggcaagattttttacgtaataatgctaaaagtatgagatgtgctttactaagccatcgcgatggagcaaaagtatgtttaggtacacgctggacagaacaattgtatgaaactgctgaaaatatgttagcctttttatgccaacaaggtttttcactagagaatgcattatatgcagtgagtgctgtgagggtgtttactttaggttgcgtattgtttgatcaagagagccaagtcgctaaagaagaaagggaaacacctactactgctagtatgccgccattagtgcgacaagtttgggaattaaaggatcaccaaggtgcagagccagccttcttattcggccttgaattgatcatatgcggattagaaaaacaacttaaatgcgaaagtgggtcttaa

SEQ ID NO: 458 - DNA, 627 bp, Artificial sequence
  SuR L6-2A12 CDS
atgggatctagattagataaaagtaaagtgattaacagcgcattagagctgcttaatgaggtcggaatcgaaggtttaacaacccgtaaactcgcccagaagctaggtgtagagcagcctacattgtattggcatgtaaaaaataagcgagctctgctcgacgccttagccattgagatgatggataggcacgcaactcacgtttgccctttagaaggggaaagctggcaagattttttacgtaataatgctaaaagtatgagatgtgctttactaagccatcgcgatggagcaaaagtatgtttaggtacacgctggacagaacaaatgtatgaaactgctgaaaatcaattagcctttttatgccaacaaggtttttcactagagaatgcattatatgcaatgagtgctgtgagggtgtttactttaggttgcgtattgtttgatcaagagagccaagtcgctaaagaagaaagggaaacacctactactgctagtatgccgccattagtgcgacaagcttgggaattaaaggatcaccaaggtgcagagccagccttcttattcggccttgaattgatcatatgcggattagaaaaacaacttaaatgcgaaagtgggtcttaa

SEQ ID NO: 459 - DNA, 626 bp, Artificial sequence
  SuR L6-2B04 CDS
atgggatctagattagataaaagtaaagtgattaacagcgcattagagctgcttaatgaggtcggaatcgaaggtttaacaacccgtaaactcgcccagaagctaggtgtagagcagcctacattgtattggcatgtaaaaaataagcgagctctgctcgacgccttagccattgagatgatggataggcaccaaactcacgtgtgccctttagaaggggaaagctggcaagattttttacgtaataatgctaaaagtatgagatgtgctttactaagccatcgcgatggagcaaaagtatgtttaggtacacgctggacagaaaaacaatatgaaagtgctgaaaatatgttagcctttttatgccaacaaggtttttcactagagaatgcattatatgcagtgagtgctgtgagggtgtttactttaggttgcgtattgtttgatcaagagctccaagtcgctaaagaagaaagggaaacacctactactgctagtatgccgccattattgcgacaaggttgggaattaaatgatcaccaaggtgcagagccagccttcttattcggccttgaattgatcatatgcggattagaaaaacaacttaaatgcgaaagtgggtctaa

SEQ ID NO: 460 - DNA, 627 bp, Artificial sequence
  SuR L6-2B06 CDS
atgggatctagattagataaaagtaaagtgattaacagcgcattagagctgcttaatgaggtcggaatcgaaggtttaacaacccgtaaactcgcccagaagctaggtgtagagcagcctacattgtattggcatgtaaaaaataagcgagctctgctcgacgccttagccattgagatgatggataggcaccaaactcactattgccctttagaaggggaaagctggcaagattttttacgtaataatgctaaaagtatgagatgtgctttactaagccatcgcgatggagcaaaagtatgtttaggtacacgctggacagaacaacattatgaaggtgctgaaaatatgttagcctttttatgccaacaaggtttttcactagagaatgcattatatgcaatgagtgctgtgagggtgtttactttaggttgcgtattgtttgatcaagagctccaagtcgctaaagaagaaagggaaacacctactactgctagtatgccgccattagtgcgacaagtttgggaattaaaggatcaccaaggtgcagagccagccttcttattcggccttgaattgatcatatgcggattagaaaaacaacttaaatgcgaaagtgggtcttaa

SEQ ID NO: 461 - DNA, 627 bp, Artificial sequence
  SuR L6-2B08 CDS
  misc_feature (455)..(455): n is a, c, g, or t
atgggatctagattagataaaagtaaagtgattaacagcgcattagagctgcttaatgaggtcggaatcgaaggtttaacaacccgtaaactcgcccagaagctaggtgtagagcagcctacattgtattggcatgtaaaaaataagcgagctctgctcgacgccttagccattgagatgatggataggcacgcaactcacgtttgccctttagaaggggaaagctggcaagattttttacgtaataatgctaaaagtatgagatgtgctttactaagccatcgcgatggagcaaaagtatgtttaggtacacgctggacagaacaaatgtatgaaactgctgaaaatcaattagcctttttatgccaacaaggtttttcactagagaatgcattatatgcaatgagtgctgtgagggtgtttactttaggttgcgtattgtttgatcaagaganccaagtcgctaaagaagaaagggaaacacctactactgctagtatgccgccattattgcgacaagtttgggaattaaaggatcaccaaggtgcagagccagccttcttattcggccttgaattgatcatatgcggattagaaaaacaacttaaatgcgaaagtgggtcttaa

SEQ ID NO: 462 - DNA, 627 bp, Artificial sequence
  SuR L6-2B09 CDS
atgggatctagattagataaaagtaaagtgattaacagcgcattagagctgcttaatgaggtcggaatcgaaggtttaacaacccgtaaactcgcccagaagctaggtgtagagcagcctacattgtattggcatgtaaaaaataagcgagctctgctcgacgccttagccattgagatgatggataggcacgcaactcactattgccctttagaaggggaaagctggcaagattttttacgtaatactgctaaaagtatgagatgtgctttactaagccatcgcgatggagcaaaagtatgtttaggtacacgctggacagaaaaacaatatgaaactgctgaaaatcaattagcctttttatgccaacaaggtttttcactagagaatgcattatatgcaatgagtgctgtgagggtgtttactttaggttgcgtattgtttgatcaagagctccaagtcgctaaagaagaaagggaaacacctactactgctagtatgccgccattagtgcgacaagtttgggaattaaaggatcaccaaggtgcagagccagccttcttattcggccttgaattgatcatatgcggattagaaaaacaacttaaatgcgaaagtgggtcttaa

SEQ ID NO: 463 - DNA, 627 bp, Artificial sequence
  SuR L6-2B10 CDS
  misc_feature (193)..(193): n is a, c, g, or t
atgggatctagattagataaaagtaaagtgattaacagcgcattagagctgcttaatgaggtcggaatcgaaggtttaacaacccgtaaactcgcccagaagctaggtgtagagcagcctacattgtattggcatgtaaaaaataagcgagctctgctcgacgccttagccattgagatgatggataggcacncaactcactattgccctttagaaggggaaagctggcaagattttttacgtaatactgctaaaagtatgagatgtgctttactaagccatcgcgatggagcaaaagtatgtttaggtacacgctggacagaaaaacaatatgaaactgctgaaaatcaattagcctttttatgccaacaaggtttttcactagagaatgcattatatgcaatgagtgctgtgagggtgtttactttaggttgcgtattgtttgatcaagagagccaagtcgctaaagaagaaagggaaacacctactactgctagtatgccgccattagtgcgacaaggttgggaattaaaggatcaccaaggtgcagagccagccttcttattcggccttgaattgatcatatgcggattagaaaaacaacttaaatgcgaaagtgggtcttaa

SEQ ID NO: 464 - DNA, 627 bp, Artificial sequence
  SuR L6-2B11 CDS
atgggatctagattagataaaagtaaagtgattaacagcgcattagagctgcttaatgaggtcggaatcgaaggtttaacaacccgtaaactcgcccagaagctaggtgtagagcagcctacattgtattggcatgtaaaaaataagcgagctctgctcgacgccttagccattgagatgatggataggcaccaaactcacatgtgccctttagaaggggaaagctggcaagattttttacgtaataatgctaaaagtatgagatgtgctttactaagccatcgcgatggagcaaaagtatgtttaggtacacgctggacagaaaaacattatgaaactgctgaaaatatgttagcctttttatgccaacaaggtttttcactagagaatgcattatatgcagtgagtgctgtgagggtgtttactttaggttgcgtattgtttgatcaagagagccaagtcgctaaagaagaaagggaaacacctactactgctagtatgccgccattagtgcgacaaggttgggaattaaaggatcaccaaggtgcagagccagccttcttattcggccttgaattgatcatatgcggattagaaaaacaacttaaatgcgaaagtgggtcttaa

SEQ ID NO: 465 - DNA, 627 bp, Artificial sequence
  SuR L6-2C02 CDS
atgggatctagattagataaaagtaaagtgattaacagcgcattagagctgcttaatgaggtcggaatcgaaggtttaacaacccgtaaactcgcccagaagctaggtgtagagcagcctacattgtattggcatgtaaaaaataagcgagctctgctcgacgccttagccattgagatgatggataggcaccaaactcacttgtgccctttagaaggggaaagctggcaagattttttacgtaataatgctaaaagtatgagatgtgctttactaagccatcgcgatggagcaaaagtatgtttaggtacacgctggacagaaaaacaatatgaaagtgctgaaaatatgttagcctttttatgccaacaaggtttttcactagagaatgcattatatgcaatgagtgctgtgagggtgtttactttaggttgcgtattgtttgatcaagagagccaagtcgctaaagaagaaagggaaacacctactactgctagtatgccgccattagtgcgacaagtttgggaattaaaggatcaccaaggtgcagagccagccttcttattcggccttgaattgatcatatgcggattagaaaaacaacttaaatgcgaaagtgggtcttaa

SEQ ID NO: 466 - DNA, 627 bp, Artificial sequence
  SuR L6-2C05 CDS
atgggatctagattagataaaagtaaagtgattaacagcgcattagagctgcttaatgaggtcggaatcgaaggtttaacaacccgtaaactcgcccagaagctaggtgtagagcagcctacattgtattggcatgtaaaaaataagcgagctctgctcgacgccttagccattgagatgatggataggcaccaaactcactattgccctttagaaggggaaagctggcaagattttttacgtaatactgctaaaagtatgagatgtgctttactaagccatcgcgatggagcaaaagtatgtttaggtacacgctggacagaaaaacattatgaaactgctgaaaatcaattagcctttttatgccaacaaggtttttcactagagaatgcattatatgcagtgagtgctgtgagggtgtttactttaggttgcgtattgtttgatcaagagagccaagtcgctaaagaagaaagggaaacacctactactgctagtatgccgccattagtgcgacaagtttgggaattaaaggatcaccaaggtgcagagccagccttcttattcggccttgaattgatcatatgcggattagaaaaacaacttaaatgcgaaagtgggtcttaa

SEQ ID NO: 467 - DNA, 627 bp, Artificial sequence
  SuR L6-2C09 CDS
atgggatctagattagataaaagtaaagtgattaacagcgcattagagctgcttaatgaggtcggaatcgaaggtttaacaacccgtaaactcgcccagaagctaggtgtagagcagcctacattgtattggcatgtaaaaaataagcgagctctgctcgacgccttagccattgagatgatggataggcaccaaactcactattgccctttagaaggggaaagctggcaagattttttacgtaatactgctaaaagtatgagatgtgctttactaagccatcgcgatggagcaaaagtatgtttaggtacacgctggacagaacaattgtatgaaactgctgaaaatcaattagcctttttatgccaacaaggtttttcactagagaatgcattatatgcaatgagtgctgtgagggtgtttactttaggttgcgtattgtttgatcaagagctccaagtcgctaaagaagaaagggaaacacctactactgctagtatgccgccattattgcgacaagcttgggaattaaaggatcaccaaggtgcagagccagccttcttattcggccttgaattgatcatatgcggattagaaaaacaacttaaatgcgaaagtgggtcttaa

SEQ ID NO: 468 - DNA, 627 bp, artificial sequence
  SuR L6-2C10 CDS
  misc_feature (204)..(204): n is a, c, g, or t
  misc_feature (337)..(337): n is a, c, g, or t
atgggatctagattagataaaagtaaagtgattaacagcgcattagagctgcttaatgaggtcggaatcgaaggtttaacaacccgtaaactcgcccagaagctaggtgtagagcagcctacattgtattggcatgtaaaaaataagcgagctctgctcgacgccttagccattgagatgatggataggcaccaaactcactantgccctttagaaggggaaagctggcaagattttttacgtaatactgctaaaagtatgagatgtgctttactaagccatcgcgatggagcaaaagtatgtttaggtacacgctggacagaacaacaatatgaanctgctgaaaatctgttagcctttttatgccaacaaggtttttcactagagaatgcattatatgcaatgagtgctgtgagggtgtttactttaggttgcgtattgtttgatcaagagatccaagtcgctaaagaagaaagggaaacacctactactgctagtatgccgccattattgcgacaagttttggaattaaaggatcaccaaggtgcagagccagccttcttattcggccttgaattgatcatatgcggattagaaaaacaacttaaatgcgaaagtgggtcttaa

SEQ ID NO: 469 - DNA, 627 bp, Artificial sequence
  SuR L6-2C11 CDS
atgggatctagattagataaaagtaaagtgattaacagcgcattagagctgcttaatgaggtcggaatcgaaggtttaacaacccgtaaactcgcccagaagctaggtgtagagcagcctacattgtattggcatgtaaaaaataagcgagctctgctcgacgccttagccattgagatgatggataggcaccaaactcactattgccctttagaaggggaaagctggcaagattttttacgtaatactgctaaaagtatgagatgtgctttactaagccatcgcgatggagcaaaagtatgtttaggtacacgctggacagaaaaacattatgaaactgctgaaaatatgttagcctttttatgccaacaaggtttttcactagagaatgcattatatgcagtgagtgctgtgagggtgtttactttaggttgcgtattgtttgatcaagagagccaagtcgctaaagaagaaagggaaacacctactactgctagtatgccgccattattgcgacaagtttgggaattaaaggatcaccaaggtgcagagccagccttcttattcggccttgaattgatcatatgcggattagaaaaacaacttaaatgcgaaagtgggtcttaa

SEQ ID NO: 470 - DNA, 627 bp, Artificial sequence
  SuR L6-2D01 CDS
atgggatctagattagataaaagtaaagtgattaacagcgcattagagctgcttaatgaggtcggaatcgaaggtttaacaacccgtaaactcgcccagaagctaggtgtagagcagcctacattgtattggcatgtaaaaaataagcgagctctgctcgacgccttagccattgagatgatggataggcaccaaactcacgtttgccctttagaaggggaaagctggcaagattttttacgtaataatgctaaaagtatgagatgtgctttactaagccatcgcgatggagcaaaagtatgtttaggtacacgctggacagaacaattgtatgaaactgctgaaaatatgttagcctttttatgccaacaaggtttttcactagagaatgcattatatgcaatgagtgctgtgagggtgtttactttaggttgcgtattgtttgatcaagagagccaagtcgctaaagaagaaagggaaacacctactactgctagtatgccgccattagtgcgacaaggttgggaattaaaggatcaccaaggtgcagagccagccttcttattcggccttgaattgatcatatgcggattagaaaaacaacttaaatgcgaaagtgggtcttaa

SEQ ID NO: 471 - DNA, 627 bp, Artificial sequence
  SuR L6-2D02 CDS
  misc_feature (328)..(328): n is a, c, g, or t
atgggatctagattagataaaagtaaagtgattaacagcgcattagagctgcttaatgaggtcggaatcgaaggtttaacaacccgtaaactcgcccagaagctaggtgtagagcagcctacattgtattggcatgtaaaaaataagcgagctctgctcgacgccttagccattgagatgatggataggcacgcaactcacttgtgccctttagaaggggaaagctggcaagattttttacgtaataatgctaaaagtatgagatgtgctttactaagccatcgcgatggagcaaaagtatgtttaggtacacgctggacagaaaaantgtatgaaagtgctgaaaatcaattagcctttttatgccaacaaggtttttcactagagaatgcattatatgcaatgagtgctgtgagggtgtttactttaggttgcgtattgtttgatcaagagctccaagtcgctaaagaagaaagggaaacacctactactgctagtatgccgccattattgcgacaagcttgggaattaaaggatcaccaaggtgcagagccagccttcttattcggccttgaattgatcatatgcggattagaaaaacaacttaaatgcgaaagtgggtcttaa

SEQ ID NO: 472 - DNA, 627 bp, Artificial sequence
  SuR L6-2D03 CDS
atgggatctagattagataaaagtaaagtgattaacagcgcattagagctgcttaatgaggtcggaatcgaaggtttaacaacccgtaaactcgcccagaagctaggtgtagagcagcctacattgtattggcatgtaaaaaataagcgagctctgctcgacgccttagccattgagatgatggataggcaccaaactcactattgccctttagaaggggaaagctggcaagattttttacgtaatactgctaaaagtatgagatgtgctttactaagccatcgcgatggagcaaaagtatgtttaggtacacgctggacagaacaacaatatgaaactgctgaaaatatgttagcctttttatgccaacaaggtttttcactagagaatgcattatatgcagtgagtgctgtgaggaactttactttaggttgcgtattgtttgatcaagagagccaagtcgctaaagaagaaagggaaacacctactactgctagtatgccgccattagtgcgacaagcttgggaattaaaggatcaccaaggtgcagagccagccttcttattcggccttgaattgatcatatgcggattagaaaaacaacttaaatgcgaaagtgggtcttaa

SEQ ID NO: 473 - DNA, 627 bp, Artificial sequence
  SuR L6-2D04 CDS
atgggatctagattagataaaagtaaagtgattaacagcgcattagagctgcttaatgaggtcggaatcgaaggtttaacaacccgtaaactcgcccagaagctaggtgtagagcagcctacattgtattggcatgtaaaaaataagcgagctctgctcgacgccttagccattgagatgatggataggcaccaaactcacttttgccctttagaaggggaaagctggcaagattttttacgtaataatgctaaaagtatgagatgtgctttactaagccatcgcgatggagcaaaagtatggttaggtacacgctggacagaacaaatgtatgaaactgctgaaaatatgttagcctttttatgccaacaaggtttttcactagagaatgcattatatgcagtgagtgctgtgaggaactttactttaggttgcgtattgtttgatcaagagagccaagtcgctaaagaagaaagggaaacacctactactgctagtatgccgccattattgcgacaaggttgggaattaaaggatcaccaaggtgcagagccagccttcttattcggccttgaattgatcatatgcggattagaaaaacaacttaaatgcgaaagtgggtcttaa

SEQ ID NO: 474 - DNA, 627 bp, Artificial sequence
  SuR L6-2D07 CDS
atgggatctagattagataaaagtaaagtgattaacagcgcattagagctgcttaatgaggtcggaatcgaaggtttaacaacccgtaaactcgcccagaagctaggtgtagagcagcctacattgtattggcatgtaaaaaataagcgagctctgctcgacgccttagccattgagatgatggataggcaccaaactcacttttgccctttagaaggggaaagctggcaagattttttacgtaatactgctaaaagtatgagatgtgctttactaagccatcgcgatggagcaaaagtatgtttaggtacacgctggacagaacaacaatatgaaactgctgaaaatatgttagcctttttatgccaacaaggtttttcactagagaatgcattatatgcaatgagtgctgtgagggtgtttactttaggttgcgtattgtttgatcaagagagccaagtcgctaaagaagaaagggaaacacctactactgctagtatgccgccattagtgcgacaagcttgggaattaaaggatcaccaaggtgcagagccagccttcttattcggccttgaattgatcatatgcggattagaaaaacaacttaaatgcgaaagtgggtcttaa

SEQ ID NO: 475 - DNA, 627 bp, Artificial sequence
  SuR L6-2D11 CDS
atgggatctagattagataaaagtaaagtgattaacagcgcattagagctgcttaatgaggtcggaatcgaaggtttaacaacccgtaaactcgcccagaagctaggtgtagagcagcctacattgtattggcatgtaaaaaataagcgagctctgctcgacgccttagccattgagatgatggataggcaccaaactcactattgccctttagaaggggaaagctggcaagattttttacgtaatactgctaaaagtatgagatgtgctttactaagccatcgcgatggagcaaaagtatgtttaggtacacgctggacagaacaacaatatgaaagtgctgaaaatcaattagcctttttatgccaacaaggtttttcactagagaatgcattatatgcagtgagtgctgtgagggtgtttactttaggttgcgtattgtttgatcaagagagccaagtcgctaaagaagaaagggaaacacctactactgctagtatgccgccattattgcgacaagcttgggaattaaaggatcaccaaggtgcagagccagccttcttattcggccttgaattgatcatatgcggattagaaaaacaacttaaatgcgaaagtgggtcttaa

SEQ ID NO: 476 - DNA, 627 bp, Artificial sequence
  SuR L6-2D12 CDS
atgggatctagattagataaaagtaaagtgattaacagcgcattagagctgcttaatgaggtcggaatcgaaggtttaacaacccgtaaactcgcccagaagctaggtgtagagcagcctacattgtattggcatgtaaaaaataagcgagctctgctcgacgccttagccattgagatgatggataggcaccaaactcacatgtgccctttagaaggggaaagctggcaagattttttacgtaataatgctaaaagtatgagatgtgctttactaagccatcgcgatggagcaaaagtatgtttaggtacacgctggacagaaaaaatgtatgaagctgctgaaaatatgttagcctttttatgccaacaaggtttttcactagagaatgcattatatgcagtgagtgctgtgagggtgtttactttaggttgcgtattgtttgatcaagagctccaagtcgctaaagaagaaagggaaacacctactactgctagtatgccgccattattgcgacaagcttgggaattaaaggatcaccaaggtgcagagccagccttcttattcggccttgaattgatcatatgcggattagaaaaacaacttaaatgcgaaagtgggtcttaa

SEQ ID NO: 477 - DNA, 627 bp, Artificial sequence
  SuR L6-2E02 CDS
atgggatctagattagataaaagtaaagtgattaacagcgcattagagctgcttaatgaggtcggaatcgaaggtttaacaacccgtaaactcgcccagaagctaggtgtagagcagcctacattgtattggcatgtaaaaaataagcgagctctgctcgacgccttagccattgagatgatggataggcacgcaactcactattgccctttagaaggggaaagctggcaagattttatacgtaatactgctaaaagtatgagatgtgctttactaagccatcgcgatggagcaaaagtatgtttaggtacacgctggacagaaaaacattatgaaactgctgaaaatatgttagcctttttatgccaacaaggtttttcactagagaatgcattatatgcagtgagtgctgtggggaactttactttaggttgcgtattgtttgatcaagagagccaagtcgctaaagaagaaagggaaacacctactactgctagtatgccgccattattgcgacaagtttgggaattaaaggatcaccaaggtgcagagccagccttcttattcggccttgaattgatcatatgcggattagaaaaacaacttaaatgcgaaagtgggtcttaa

SEQ ID NO: 478 - DNA, 627 bp, Artificial sequence
  SuR L62E03 CDS
atgggatctagattagataaaagtaaagtgattaacagcgcattagagctgcttaatgaggtcggaatcgaaggtttaacaacccgtaaactcgcccagaagctaggtgtagagcagcctacattgtattggcatgtaaaaaataagcgagctctgctcgacgccttagccattgagatgatggataggcacgcaactcacttgtgccctttagaaggggaaagctggcaagattttttacgtaatactgctaaaagtatgagatgtgctttactaagccatcgcgatggagcaaaagtatgtttaggtacacgctggacagaaaaacaatatgaaagtgctgaaaatcaattagcctttttatgccaacaaggtttttcactagagaatgcattatatgcaatgagtgctgtgagggtgtttactttaggttgcgtattgtttgatcaagagagccaagtcgctaaagaagaaagggaaacacctactactgctagtatgccgccattattgcgacaagtttgggaattaaaggatcaccaaggtgcagagccagccttcttattcggccttgaattgatcatatgcggattagaaaaacaacttaaatgcgaaagtgggtcttaa

SEQ ID NO: 479 - DNA, 627 bp, Artificial sequence
  SuR L6-2E04 CDs
atgggatctagattagataaaagtaaagtgattaacagcgcattagagctgcttaatgaggtcggaatcgaaggtttaacaacccgtaaactcgcccagaagctaggtgtagagcagcctacattgtattggcatgtaaaaaataagcgagctctgctcgacgccttagccattgagatgatggataggcaccaaactcactattgccctttagaaggggaaagctggcaagattttttacgtaataatgctaaaagtatgagatgtgctttactaagccatcgcgatggagcaaaagtatgtttaggtacacgctggacagaacaaatgtatgaaagtgctgaaaatatgttagcctttttatgccaacaaggtttttcactagagaatgcattatatgcagtgagtgctgtgagggtgtttactttaggttgcgtattgtttgatcaagagagccaagtcgctaaagaagaaagggaaacacctactactgctagtatgccgccattattgcgacaaggttgggaattaaaggatcaccaaggtgcagagccagccttcttattcggccttgaattgatcatatgcggattagaaaaacaacttaaatgcgaaagtgggtcttaa

SEQ ID NO: 480 - DNA, 627 bp, Artificial sequence
  SuR L6-2E05 CDS
atgggatctagattagataaaagtaaagtgattaacagcgcattagagctgcttaatgaggtcggaatcgaaggtttaacaacccgtaaactcgcccagaagctaggtgtagagcagcctacattgtattggcatgtaaaaaataagcgagctctgctcgacgccttagccattgagatgatggataggcaccaaactcacttttgccctttagaaggggaaagctggcaagattttttacgtaataatgctaaaagtatgagatgtgctttactaagccatcgcgatggagcaaaagtatgtttaggtacacgctggacagaacaaatgtatgaaggtgctgaaaatatgttagcctttttatgccaacaaggtttttcactagagaatgcattatatgcaatgagtgctgtgagggtgtttactttaggttgcgtattgtttgatcaagagagccaagtcgctaaagaagaaagggaaacacctactactgctagtatgccgccattattgcgacaaggttgggaattaaaggatcaccaaggtgcagagccagccttcttattcggccttgaattgatcatatgcggattagaaaaacaacttaaatgcgaaagtgggtcttaa

SEQ ID NO: 481 - DNA, 627 bp, Artificial sequence
  SuR L6-2E07 CDS
atgggatctagattagataaaagtaaagtgattaacagcgcattagagctgcttaatgaggtcggaatcgaaggtttaacaacccgtaaactcgcccagaagctaggtgtagagcagcctacattgtattggcatgtaaaaaataagcgagctctgctcgacgccttagccattgagatgatggataggcaccaaactcactattgccctttagaaggggaaagctggcaagattttttacgtaataatgctaaaagtatgagatgtgctttactaagccatcgcgatggagcaaaagtatgtttaggtacacgctggacagaacaacattatgaagctgctgaaaatatgttagcctttttatgccaacaaggtttttcactagagaatgcattatatgcaatgagtgctgtgagggtgtttactttaggttgcgtattgtttgatcaagagagccaagtcgctaaagaagaaagggaaacacctactactgctagtatgccgccattagtgcgacaagcttgggaattaaaggatcaccaaggtgcagagccagccttcttattcggccttgaattgatcatatgcggattagaaaaacaacttaaatgcgaaagtgggtcttaa

SEQ ID NO: 482 - DNA, 627 bp, Artificial sequence
  SuR L6-2E08 CDS
atgggatctagattagataaaagtaaagtgattaacagcgcattagagctgcttaatgaggtcggaatcgaaggtttaacaacccgtaaactcgcccagaagctaggtgtagagcagcctacattgtattggcatgtaaaaaataagcgagctctgctcgacgccttagccattgagatgatggataggcacgcaactcactattgccctttagaaggggaaagctggcaagattttttacgtaataatgctaaaagtatgagatgtgctttactaagccatcgcgatggagcaaaagtatgtttaggtacacgctggacagaacaattgtatgaaactgctgaaaatcaattagcctttttatgccaacaaggtttttcactagagaatgcattatatgcaatgagtgctgtgaggaactttactttaggttgcgtattgtttgatcaagagagccaagtcgctaaagaagaaagggaaacacctactactgctagtatgccgccattagtgcgacaagcttgggaattaaaggatcaccaaggtgcagagccagccttcttattcggccttgaattgatcatatgcggattagaaaaacaacttaaatgcgaaagtgggtcttaa

SEQ ID NO: 483 - DNA, 627 bp, Artificial sequence
  SuR L6-2E09 CDS
atgggatctagattagataaaagtaaagtgattaacagcgcattagagctgcttaatgaggtcggaatcgaaggtttaacaacccgtaaactcgcccagaagctaggtgtagagcagcctacattgtattggcatgtaaaaaataagcgagctctgctcgacgccttagccattgagatgatggataggcacgcaactcacatgtgccctttagaaggggaaagctggcaagattttttacgtaatactgctaaaagtatgagatgtgctttactaagccatcgcgatggagcaaaagtatgtttaggtacacgctggacagaaaaacaatatgaaactgctgaaaatatgttagcctttttatgccaacaaggtttttcactagagaatgcattatatgcagtgagtgctgtgagggtgtttactttaggttgcgtattgtttgatcaagagagccaagtcgctaaagaagaaagggaaacacctactactgctagtatgccgccattattgcgacaagtttgggaattaaaggatcaccaaggtgcagagccagccttcttattcggccttgaattgatcatatgcggattagaaaaacaacttaaatgcgaaagtgggtcttaa

SEQ ID NO: 484 - DNA, 627 bp, Artificial sequence
  SuR L6-2E11 CDS
atgggatctagattagataaaagtaaagtgattaacagcgcattagagctgcttaatgaggtcggaatcgaaggtttaacaacccgtaaactcgcccagaagctaggtgtagagcagcctacattgtattggcatgtaaaaaataagcgagctctgctcgacgccttagccattgagatgatggataggcacgcaactcactattgccctttagaaggggaaagctggcaagattttttacgtaatactgctaaaagtatgagatgtgctttactaagccatcgcgatggagcaaaagtatgtttaggtacacgctggacagaaaaattgtatgaaactgctgaaaatatgttagcctttttatgccaacaaggtttttcactagagaatgcattatatgcagtgagtgctgtgagggtgtttactttaggttgcgtattgtttgatcaagagctccaagtcgctaaagaagaaagggaaacacctactactgctagtatgccgccattagtgcgacaagcttgggaattaaaggatcaccaaggtgcagagccagccttcttattcggccttgaattgatcatatgcggattagaaaaacaacttaaatgcgaaagtgggtcttaa

SEQ ID NO: 485 - DNA, 627 bp, Artificial sequence
  SuR L6-2F08 CDS
atgggatctagattagataaaagtaaagtgattaacagcgcattagagctgcttaatgaggtcggaatcgaaggtttaacaacccgtaaactcgcccagaagctaggtgtagagcagcctacattgtattggcatgtaaaaaataagcgagctctgctcgacgccttagccattgagatgatggataggcacgcaactcacttttgccctttagaaggggaaagctggcaagattttttacgtaatactgctaaaagtatgagatgtgctttactaagccatcgcgatggagcaaaagtatgtttaggtacacgctggacagaacaattgtatgaaactgctgaaaatatgttagcctttttatgccaacaaggtttttcactagagaatgcattatatgcaatgagtgctgtgagggtgtttactttaggttgcgtattgtttgatcaagagagccaagtcgctaaagaagaaagggaaacacctactactgctagtatgccgccattagtgcgacaaggttgggaattaaaggatcaccaaggtgcagagccagccttcttattcggccttgaattgatcatatgcggattagaaaaacaacttaaatgcgaaagtgggtcttaa

SEQ ID NO: 486 - DNA, 627 bp, Artificial sequence
  SuR L6-2F10 CDS
atgggatctagattagataaaagtaaagtgattaacagcgcattagagctgcttaatgaggtcggaatcgaaggtttaacaacccgtaaactcgcccagaagctaggtgtagagcagcctacattgtattggcatgtaaaaaataagcgagctctgctcgacgccttagccattgagatgatggataggcaccaaactcacttgtgccctttagaaggggaaagctggcaagattttttacgtaataatgctaaaagtatgagatgtgctttactcagccatcgcgatggagcaaaagtatgtttaggtacacgctggacagaaaaacattatgaagctgctgaaaatcaattagcctttttatgccaacaaggtttttcactagagaatgcattatatgcaatgagtgctgtgagggtgtttactttaggttgcgtattgtttgatcaagagagccaagtcgctaaagaagaaagggaaacacctactactgctagtatgccgccattattgcgacaaggttgggaattaaaggatcaccaaggtgcagagccagccttcttattcggccttgaattgatcatatgcggattagaaaaacaacttaaatgcgaaagtgggtcttaa

SEQ ID NO: 487 - DNA, 627 bp, Artificial sequence
  SuR L6-2F11 CDS
  misc_feature (193)..(193): n is a, c, g, or t
  misc_feature (328)..(328): n is a, c, g, or t
atgggatctagattagataaaagtaaagtgattaacagcgcattagagctgcttaatgaggtcggaatcgaaggtttaacaacccgtaaactcgcccagaagctaggtgtagagcagcctacattgtattggcatgtaaaaaataagcgagctctgctcgacgccttagccattgagatgatggataggcacncaactcactattgccctttagaaggggaaagctggcaagattttttacgtaataatgctaaaagtatgagatgtgctttactaagccatcgcgatggagcaaaagtatggttaggtacacgctggacagaacaantgtatgaaactgctgaaaatcaattagcctttttatgccaacaaggtttttcactagagaatgcattatatgcagtgagtgctgtgagggtgtttactttaggttgcgtattgtttgatcaagagctccaagtcgctaaagaagaaagggaaacacctactactgctagtatgccgccattattgcgacaaggtttggaattaaaggatcaccaaggtgcagagccagccttcttattcggccttgaattgatcatatgcggattagaaaaacaacttaaatgcgaaagtgggtcttaa

SEQ ID NO: 488 - DNA, 627 bp, Artificial sequence
  SuR L6-2F12 CDS
atgggatctagattagataaaagtaaagtgattaacagcgcattagagctgcttaatgaggtcggaatcgaaggtttaacaacccgtaaactcgcccagaagctaggtgtagagcagcctacattgtattggcatgtaaaaaataagcgagctctgctcgacgccttagccattgagatgatggataggcacgcaactcactattgccctttagaaggggaaagctggcaagattttttacgtaatactgctaaaagtatgagatgtgctttactaagccatcgcgatggagcaaaagtatgtttaggtacacgctggacagaacaacaatatgaaagtgctgaaaatatgttagcctttttatgccaacaaggtttttcactagagaatgcattatatgcaatgagtgctgtgagggtgtttactttaggttgcgtattgtttgatcaagagctccaagtcgctaaagaagaaagggaaacacctactactgctagtatgccgccattagtgcgacaaggttgggaattaaaggatcaccaaggtgcagagccagccttcttattcggccttgaattgatcatatgcggattagaaaaacaacttaaatgcgaaagtgggtcttaa

SEQ ID NO: 489 - DNA, 627 bp, Artificial sequence
  SuR L6-2G01 CDS
atgggatctagattagataaaagtaaagtgattaacagcgcattagagctgcttaatgaggtcggaatcgaaggtttaacaacccgtaaactcgcccagaagctaggtgtagagcagcctacattgtattggcatgtaaaaaataagcgagctctgctcgacgccttagccattgagatgatggataggcacgcaactcactattgccctttagaaggggaaagctggcaagattttttacgtaatactgctaaaagtatgagatgtgctttactaagccatcgcgatggagcaaaagtatgtttaggtacacgctggacagaacaacaatatgaaactgctgaaaatatgttagcctttttatgccaacaaggtttttcactagagaatgcattatatgcagtgagtgctgtgagggtgtttactttaggttgcgtattgtttgatcaagagctccaagtcgctaaagaagaaagggaaacacctactactgctagtatgccgccattagtgcgacaagcttgggaattaaaggatcaccaaggtgcagagccagccttcttattcggccttgaattgatcatatgcggattagaaaaacaacttaaatgcgaaagtgggtcttaa

SEQ ID NO: 490 - DNA, 627 bp, Artificial sequence
  SuR L6-2G02 CDS
  misc_feature (204)..(204): n is a, c, g, or t
  misc_feature (303)..(303): n is a, c, g, or t
  misc_feature (420)..(420): n is a, c, g, or t
atgggatctagattagataaaagtaaagtgattaacagcgcattagagctgcttaatgaggtcggaatcgaaggtttaacaacccgtaaactcgcccagaagctaggtgtagagcagcctacattgtattggcatgtaaaaaataagcgagctctgctcgacgccttagccattgagatgatggataggcacccaactcactantgccctttagaaggggaaagctggcaagattttttacgtaatamtgctaaaagtatgagatgtgctttactaagccatcgcgatggagcaaaagtatgnttaggtacacgctggacagaacaactgtatgaaactgctgaaaatatgttagcctttttatgccaacaaggtttttcactagagaatgcattatatgcaatgagtgctgtgagggtntttactttaggttgcgtattgtttgatcaagagagccaagtcgctaaagaagaaagggaaacacctactactgctagtatgccgccattaktgcgacaagtttgggaattaaaggatcaccaaggtgcagagccagccttcttattcggccttgaattgatcatatgcggattagaaaaacaacttaaatgcgaaagtgggtcttaa

SEQ ID NO: 491 - DNA, 627 bp, Artificial sequence
  SuR L6-2G03 CDS
  misc_feature (513)..(513): n is a, c, g, or t
atgggatctagattagataaaagtaaagtgattaacagcgcattagagctgcttaatgaggtcggaatcgaaggtttaacaacccgtaaactcgcccagaagctaggtgtagagcagcctacattgtattggcatgtaaaaaataagcgagctctgctcgacgccttagccattgagatgatggataggcacgcaactcactattgccctttagaaggggaaagctggcaagattttttacgtaataatgctaaaagtatgagatgtgctttactaagccatcgcgatggagcaaaagtatgtttaggtacacgctggacagaacaattgtatgaaactgctgaaaatcaattagcctttttatgccaacaaggtttttcactagagaatgcattatatgcagtgagtgctgtgagggtgtttactttaggttgcgtattgtttgatcaagagagccaagtcgctaaagaagaaagggaaacacctactactgctagtatgccgccattattncgacaaggttgggaattaaaggatcaccaaggtgcagagccagccttcttattcggccttgaattgatcatatgcggattagaaaaacaacttaaatgcgaaagtgggtcttaa

SEQ ID NO: 492 - DNA, 627 bp, Artificial sequence
  SuR L6-2G05 CDS
atgggatctagattagataaaagtaaagtgattaacagcgcattagagctgcttaatgaggtcggaatcgaaggtttaacaacccgtaaactcgcccagaagctaggtgtagagcagcctacattgtattggcatgtaaaaaataagcgagctctgctcgacgccttagccattgagatgatggataggcaccaaactcactattgccctttagaaggggaaagctggcaagattttttacgtaataatgctaaaagtatgagatgtgctttactaagccatcgcgatggagcaaaagtatgtttaggtacacgctggacagaacaacaatatgaagctgctgaaaatcaattagcctttttatgccaacaaggtttttcactagagaatgcattatatgcaatgagtgctgtgagggtgtttactttaggttgcgtattgtttgatcaagagctccaagtcgctaaagaagaaagggaaacacctactactgctagtatgccgccattagtgcgacaagcttgggaattaaaggatcaccaaggtgcagagccagccttcttattcggccttgaattgatcatatgcggattagaaaaacaacttaaatgcgaaagtgggtcttaa

SEQ ID NO: 493 - DNA, 627 bp, Artificial sequence
  SuR L6-2G10 CDS
atgggatctagattagataaaagtaaagtgattaacagcgcattagagctgcttaatgaggtcggaatcgaaggtttaacaacccgtaaactcgcccagaagctaggtgtagagcagcctacattgtattggcatgtaaaaaataagcgagctctgctcgacgccttagccattgagatgatggataggcaccaaactcactattgccctttagaaggggaaagctggcaagattttttacgtaatactgctaaaagtatgagatgtgctttactaagccatcgcgatggagcaaaagtatgtttaggtacacgctggacagaacaaatgtatgaaagtgctgaaaatatgttagcctttttatgccaacaaggtttttcactagagaatgcattatatgcagtgagtgctgtgagggtgtttactttaggttgcgtattgtttgatcaagagagccaagtcgctaaagaagaaagggaaacacctactactgctagtatgccgccattattgcgacaaggttgggaattaaaggatcaccaaggtgcagagccagccttcttattcggccttgaattgatcatatgcggattagaaaaacaacttaaatgcgaaagtgggtcttaa

SEQ ID NO: 494 - DNA, 627 bp, Artificial sequence
  SuR L6-2H01 CDS
atgggatctagattagataaaagtaaagtgattaacagcgcattagagctgcttaatgaggtcggaatcgaaggtttaacaacccgtaaactcgcccagaagctaggtgtagagcagcctacattgtattggcatgtaaaaaataagcgagctctgctcgacgccttagccattgagatgatggataggcaccaaactcactattgccctttagaaggggaaagctggcaagattttttacgtaataatgctaaaagtatgagatgtgctttactaagccatcgcgatggagcaaaagtatgtttaggtacacgctggacagaacaacaatatgaaagtgctgaaaatcaattagcctttttatgccaacaaggtttttcactagagaatgcattatatgcagtgagtgctgtgagggtgtttactttaggttgcgtattgtttgatcaagagagccaagtcgctaaagaagaaagggaaacacctactactgctagtatgccgccattagtgcgacaagcttgggaattaaaggatcaccaaggtgcagagccagccttcttattcggccttgaattgatcatatgcggattagaaaaacaacttaaatgcgaaagtgggtcttaa

SEQ ID NO: 495 - DNA, 627 bp, Artificial sequence
  SuR L6-2H02 CDS
atgggatctagattagataaaagtaaagtgattaacagcgcattagagctgcttaatgaggtcggaatcgaaggtttaacaacccgtaaactcgcccagaagctaggtgtagagcagcctacattgtattggcatgtaaaaaataagcgagctctgctcgacgccttagccattgagatgatggataggcaccaaactcactattgccctttagaaggggaaagctggcaagattttttacgtaataatgctaaaagtatgagatgtgctttactaagccatcgcgatggagcaaaagtatgtttaggtacacgctggacagaaaaattgtatgaaactgctgaaaatatgttagcctttttatgccaacaaggtttttcactagagaatgcattatatgcagtgagtgctgtgagggtgtttactttaggttgcgtattgtttgatcaagagagccaagtcgctaaagaagaaagggaaacacctactactgctagtatgccgccattattgcgacaagtttgggaattaaaggatcaccaaggtgcagagccagccttcttattcggccttgaattgatcatatgcggattagaaaaacaacttaaatgcgaaagtgggtcttaa

SEQ ID NO: 496 - DNA, 627 bp, Artificial sequence
  SuR L6-2H03 CDS
atgggatctagattagataaaagtaaagtgattaacagcgcattagagctgcttaatgaggtcggaatcgaaggtttaacaacccgtaaactcgcccagaagctaggtgtagagcagcctacattgtattggcatgtaaaaaataagcgagctctgctcgacgccttagccattgagatgatggataggcacgcaactcactattgccctttagaaggggaaagctggcaagattttttacgtaatactgctaaaagtatgagatgtgctttactaagccatcgcgatggagcaaaagtatgtttaggtacacgctggacagaacaaatgtatgaaactgctgaaaatatgttagcctttttatgccaacaaggtttttcactagagaatgcattatatgcaatgagtgctgtgagggtgtttactttaggttgcgtattgtttgatcaagagctccaagtcgctaaagaagaaagggaaacacctactactgctagtatgccgccattagtgcgacaaggttgggaattaaaggatcaccaaggtgcagagccagccttcttattcggccttgaattgatcatatgcggattagaaaaacaacttaaatgcgaaagtgggtcttaa

SEQ ID NO: 497 - DNA, 627 bp, Artificial sequence
  SuR L6-2H04 CDS
atgggatctagattagataaaagtaaagtgattaacagcgcattagagctgcttaatgaggtcggaatcgaaggtttaacaacccgtaaactcgcccagaagctaggtgtagagcagcctacattgtattggcatgtaaaaaataagcgagctctgctcgacgccttagccattgagatgatggataggcaccaaactcactattgccctttagaaggggaaagctggcaagattttttacgtaataatgctaaaagtatgagatgtgctttactaagccatcgcgatggagcaaaagtatgtttaggtacacgctggacagaacaaatgtatgaaactgctgaaaatcaattagcctttttatgccaacaaggtttttcactagagaatgcattatatgcaatgagtgctgtgagggtgtttactttaggttgcgtattgtttgatcaagagctccaagtcgctaaagaagaaagggaaacacctactactgctagtatgccgccattattgcgacaaggttgggaattaaaggatcaccaaggtgcagagccagccttcttattcggacttgaattgatcatatgcggattagaaaaacaacttaaatgcgaaagtgggtcttaa

SEQ ID NO: 498 - DNA, 627 bp, Artificial sequence
  SuR L6-2H06 CDS
atgggatctagattagataaaagtaaagtgattaacagcgcattagagctgcttaatgaggtcggaatcgaaggtttaacaacccgtaaactcgcccagaagctaggtgtagagcagcctacattgtattggcatgtaaaaaataagcgagctctgctcgacgccttagccattgagatgatggataggcacgcaactcactattgccctttagaaggggaaagctggcaagattttttacgtaatactgctaaaagtatgagatgtgctttactaagccatcgcgatggagcaaaagtatgtttaggtacacgctggacagaacaacaatatgaagctgctgaaaatcaattagcctttttatgccaacaaggtttttcactagagaatgcattatatgcagtgagtgctgtgagggtgtttactttaggttgcgtattgtttgatcaagagagccaagtcgctaaagaagaaagggaaacacctactactgctagtatgccgccattattgcgacaaggttgggaattaaaggatcaccaaggtgcagagccagccttcttattcggccttgaattgatcatatgcggattagaaaaacaacttaaatgcgaaagtgggtcttaa

SEQ ID NO: 499 - DNA, 627 bp, Artificial sequence
  SuR L6-2H07 CDS
atgggatctagattagataaaagtaaagtgattaacagcgcattagagctgcttaatgaggtcggaatcgaaggtttaacaacccgtaaactcgcccagaagctaggtgtagagcagcctacattgtattggcatgtaaaaaataagcgagctctgctcgacgccttagccattgagatgatggataggcaccaaactcactattgccctttagaaggggaaagctggcaagattttttacgtaatactgctaaaagtatgagatgtgctttactaagccatcgcgatggagcaaaagtatggttaggtacacgctggacagaacaacaatatgaaagtgctgaaaatatgttagcctttttatgccaacaaggtttttcactagagaatgcattatatgcagtgagtgctgtgagggtgtttactttaggttgcgtattgtttgatcaagagctccaagtcgctaaagaagaaagggaaacacctactactgctagtatgccgccattagtgcgacaagcttgggaattaaaggatcaccaaggtgcagagccagccttcttattcggccttgaattgatcatatgcggattagaaaaacaacttaaatgcgaaagtgggtcttaa

SEQ ID NO: 500 - DNA, 627 bp, Artificial sequence
  SuR L6-2H10 CDS
atgggatctagattagataaaagtaaagtgattaacagcgcattagagctgcttaatgaggtcggaatcgaaggtttaacaacccgtaaactcgcccagaagctaggtgtagagcagcctacattgtattggcatgtaaaaaataagcgagctctgctcgacgccttagccattgagatgatggataggcaccaaactcacatgtgccctttagaaggggaaagctggcaagattttttacgtaataatgctaaaagtatgagatgtgctttactaagccatcgcgatggagcaaaagtatgtttaggtacacgctggacagaaaaattgtatgaaactgctgaaaatcaattagcctttttatgccaacaaggtttttcactagagaatgcattatatgcagtgagtgctgtgagggtgtttactttaggttgcgtattgtttgatcaagagagccaagtcgctaaagaagaaagggaaacacctactactgctagtatgccgccattagtgcgacaagcttgggaattaaaggatcaccaaggtgcagagccagccttcttattcggccttgaattgatcatatgcggattagaaaaacaacttaaatgcgaaagtgggtcttaa

SEQ ID NO: 501 - DNA, 627 bp, Artificial sequence
  SuR  L6-2H11 CDS
atgggatctagattagataaaagtaaagtgattaacagcgcattagagctgcttaatgaggtcggaatcgaaggtttaacaacccgtaaactcgcccagaagctaggtgtagagcagcctacattgtattggcatgtaaaaaataagcgagctctgctcgacgccttagccattgagatgatggataggcaccaaactcactattgccctttagaaggggaaagctggcaagattttttacgtaatactgctaaaagtatgagatgtgctttactaagccatcgcgatggagcaaaagtatgtttaggtacacgctggacagaaaaacaatatgaaactgctgaaaatatgttagcctttttatgccaacaaggtttttcactagagaatgcattatatgcaatgagtgctgtgagggtgtttactttaggttgcgtattgtttgatcaagagagccaagtcgctaaagaagaaagggaaacacctactactgctagtatgccgccattagtgcgacaagtttgggaattaaaggatcaccaaggtgcagagccagccttcttattcggccttgaattgatcatatgcggattagaaaaacaacttaaatgcgaaagtgggtcttaa

SEQ ID NO: 502 - DNA, 627 bp, Artificial sequence
  SuR L6-3A01 CDS
atgggatctagattagataaaagtaaagtgattaacagcgcattagagctgcttaatgaggtcggaatcgaaggtttaacaacccgtaaactcgcccagaagctaggtgtagagcagcctacattgtattggcatgtaaaaaataagcgagctctgctcgacgccttagccattgagatgatggataggcaccaaactcacttttgccctttagaaggggaaagctggcaagattttttacgtaataatgctaaaagtatgagatgtgctttactaagccatcgcgatggagcaaaagtatgtttaggtacacgctggacagaacaacaatatgaaagtgctgaaaatcaattagcctttttatgccaacaaggtttttcactagagaatgcattatatgcagtgagtgctgtgagggtgtttactttaggttgcgtattgtttgatcaagagctccaagtcgctaaagaagaaagggaaacacctactactgctagtatgccgccattattgcgacaagctttggaattaaaggatcaccaaggtgcagagccagccttcttattcggccttgaattgatcatatgcggattagaaaaacaacttaaatgcgaaagtgggtcttaa

SEQ ID NO: 503 - DNA, 627 bp, Artificial sequence
  SuR L6-3A02 CDS
atgggatctagattagataaaagtaaagtgattaacagcgcattagagctgcttaatgaggtcggaatcgaaggtttaacaacccgtaaactcgcccagaagctaggtgtagagcagcctacattgtattggcatgtaaaaaataagcgagctctgctcgacgccttagccattgagatgatggataggcacgcaactcactattgccctttagaaggggaaagctggcaagattttttacgtaataatgctaaaagtatgagatgtgctttactaagccatcgcgatggagcaaaagtatgtttaggtacacgctggacagaaaaacaatatgaaagtgctgaaaatatgttagcctttttatgccaacaaggtttttcactagagaatgcattatatgcagtgagtgctgtgaggaactttactttaggttgcgtattgtttgatcaagagagccaagtcgctaaagaagaaagggaaacacctactactgctagtatgccgccattattgcgacaaggttgggaattaaaggatcaccaaggtgcagagccagccttcttattcggccttgaattgatcatatgcggattagaaaaacaacttaaatgcgaaagtgggtcttaa

SEQ ID NO: 504 - DNA, 627 bp, Artificial sequence
  SuR L6-3A03 CDS
atgggatctagattagataaaagtaaagtgattaacagcgcattagagctgcttaatgaggtcggaatcgaaggtttaacaacccgtaaactcgcccagaagctaggtgtagagcagcctacattgtattggcatgtaaaaaataagcgagctctgctcgacgccttagccattgagatgatggataggcacgcaactcacatgtgccctttagaaggggaaagctggcaagattttttacgtaataatgctaaaagtatgagatgtgctttactaagccatcgcgatggagcaaaagtatgtttaggtacacgctggacagaaaaacattatgaaagtgctgaaaatatgttagcctttttatgccaacaaggtttttcactagagaatgcattatatgcagtgagtgctgtgagggtgtttactttaggttgcgtattgtttgatcaagagctccaagtcgctaaagaagaaagggaaacacctactactgctagtatgccgccattagtgcgacaagtttgggaattaaaggatcaccaaggtgcagagccagccttcttattcggccttgaattgatcatatgcggattagaaaaacaacttaaatgcgaaagtgggtcttaa

SEQ ID NO: 505 - DNA, 627 bp, Artificial sequence
  SuR L6-3A06 CDS
  misc_feature (194)..(194): n is a, c, g, or t
  misc_feature (350)..(350): n is a, c, g, or t
atgggatctagattagataaaagtaaagtgattaacagcgcattagagctgcttaatgaggtcggaatcgaaggtttaacaacccgtaaactcgcccagaagctaggtgtagagcagcctacattgtattggcatgtaaaaaataagcgagctctgctcgacgccttagccattgagatgatggataggcaccnaactcacttgtgccctttagaaggggaaagctggcaagattttttacgtaatactgctaaaagtatgagatgtgctttactaagccatcgcgatggagcaaaagtatgtttaggtacacgctggacagaacaattgtatgaagctgctgaaaatcnrttagcctttttatgccaacaaggtttttcactagagaatgcattatatgcaatgagtgctgtgagggtgtttactttaggttgcgtattgtttgatcaagagagccaagtcgctaaagaagaaagggaaacacctactactgctagtatgccgccattagtgcgacaagtttgggaattaaaggatcaccaaggtgcagagccagccttcttattcggccttgaattgatcatatgcggattagaaaaacaacttaaatgcgaaagtgggtcttaa

SEQ ID NO: 506 - DNA, 627 bp, Artificial sequence
  SuR L6-3A11 CDS
atgggatctagattagataaaagtaaagtgattaacagcgcattagagctgcttaatgaggtcggaatcgaaggtttaacaacccgtaaactcgcccagaagctaggtgtagagcagcctacattgtattggcatgtaaaaaataagcgagctctgctcgacgccttagccattgagatgatggataggcaccaaactcactattgccctttagaaggggaaagctggcaagattttttacgtaataatgctaaaagtatgagatgtgctttactaagccatcgcgatggagcaaaagtatgtttaggtacacgctggacagaacaacattatgaaggtgctgaaaatatgttagcctttttatgccaacaaggtttttcactagagaatgcattatatgcagtgagtgctgtgagggtgtttactttaggttgcgtattgtttgatcaagagagccaagtcgctaaagaagaaagggaaacacctactactgctagtatgccgccattattgcgacaagtttgggaattaaaggatcaccaaggtgcagagccagccttcttattcggccttgaattgatcatatgcggattagaaaaacaacttaaatgcgaaagtgggtcttaa

SEQ ID NO: 507 - DNA, 627 bp, Artificial sequence
  SuR L6-3B08 CDS
atgggatctagattagataaaagtaaagtgattaacagcgcattagagctgcttaatgaggtcggaatcgaaggtttaacaacccgtaaactcgcccagaagctaggtgtagagcagcctacattgtattggcatgtaaaaaataagcgagctctgctcgacgccttagccattgagatgatggataggcacgcaactcacatttgccctttagaaggggaaagctggcaagattttttacgtaataatgctaaaagtatgagatgtgctttactaagccatcgcgatggagcaaaagtatgtttaggtacacgctggacagaacaattgtatgaaagtgctgaaaatatgttagcctttttatgccaacaaggtttttcactagagaatgcattatatgcagtgagtgctgtgagggtgtttactttaggttgcgtattgtttgatcaagagagccaagtcgctaaagaagaaagggaaacacctactactgctagtatgccgccattagtgcgacaagtttgggaattaaaggatcaccaaggtgcagagccagccttcttattcggccttgaattgatcatatgcggattagaaaaacaacttaaatgcgaaagtgggtcttaa

SEQ ID NO: 508 - DNA, 627 bp, Artificial sequence
  SuR L6-3B09 CDS
atgggatctagattagataaaagtaaagtgattaacagcgcattagagctgcttaatgaggtcggaatcgaaggtttaacaacccgtaaactcgcccagaagctaggtgtagagcagcctacattgtattggcatgtaaaaaataagcgagctctgctcgacgccttagccattgagatgatggataggcaccaaactcactattgccctttagaaggggaaagctggcaagattttttacgtaataatgctaaaagtatgagatgtgctttactaagccatcgcgatggagcaaaagtatgtttaggtacacgctggacagaaaaacaatatgaaactgctgaaaatcaattagcctttttatgccaacaaggtttttcactagagaatgcattatatgcaatgagtgctgtgaggaactttactttaggttgcgtattgtttgatcaagagagccaagtcgctaaagaagaaagggaaacacctactactgctagtatgccgccattattgcgacaaggttgggaattaaaggatcaccaaggtgcagagccagccttcttattcggccttgaattgatcatatgcggattagaaaaacaacttaaatgcgaaagtgggtcttaa

SEQ ID NO: 509 - DNA, 627 bp, Artificial sequence
  SuR L6-3C02 CDS
atgggatctagattagataaaagtaaagtgattaacagcgcattagagctgcttaatgaggtcggaatcgaaggtttaacaacccgtaaactcgcccagaagctaggtgtagagcagcctacattgtattggcatgtaaaaaataagcgagctctgctcgacgccttagccattgagatgatggataggcaccaaactcactattgccctttagaaggggaaagctggcaagattttttacgtaataatgctaaaagtatgagatgtgctttactaagccatcgcgatggagcaaaagtatgtttaggtacacgctggacagaacaacattatgaaactgctgaaaatatgttagcctttttatgccaacaaggtttttcactagagaatgcattatatgcaatgagtgctgtgagggtgtttactttaggttgcgtattgtttgatcaagagagccaagtcgctaaagaagaaagggaaacacctactactgctagtatgccgccattattgcgacaaggttgggaattaaaggatcaccaaggtgcagagccagccttcttattcggccttgaattgatcatatgcggattagaaaaacaacttaaatgcgaaagtgggtcttaa

SEQ ID NO: 510 - DNA, 627 bp, Artificial sequence
  SuR L6-3C04 CDS
  misc_feature (338)..(338): n is a, c, g, or t
  misc_feature (403)..(403): n is a, c, g, or t
atgggatctagattagataaaagtaaagtgattaacagcgcattagagctgcttaatgaggtcggaatcgaaggtttaacaacccgtaaactcgcccagaagctaggtgtagagcagcctacattgtattggcatgtaaaaaataagcgagctctgctcgacgccttagccattgagatgatggataggcacccaactcacttgtgccctttagaaggggaaagctggcaagattttttacgtaatactgctaaaagtatgagatgtgctttactaagccatcgcgatggagcaaaagtatgtttaggtacacgctggacagaacaacwrtatgaagntgctgaaaatcwrttagcctttttatgccaacaaggtttttcactagagaatgcattatatgcantgagtgctgtgagggwgtttactttaggttgcgtattgtttgatcaagagatccaagtcgctaaagaagaaagggaaacacctactactgctagtatgccgccattagtgcgacaagcttgggaattaaaggatcaccaaggtgcagagccagccttcttattcggccttgaattgatcatatgcggattagaaaaacaacttaaatgcgaaagtgggtcttaa

SEQ ID NO: 511 - DNA, 627 bp, Artificial sequence
  SuR L6-3C05 CDS
atgggatctagattagataaaagtaaagtgattaacagcgcattagagctgcttaatgaggtcggaatcgaaggtttaacaacccgtaaactcgcccagaagctaggtgtagagcagcctacattgtattggcatgtaaaaaataagcgagctctgctcgacgccttagccattgagatgatggataggcacgcaactcacatttgccctttagaaggggaaagctggcaagattttttacgtaataatgctaaaagtatgagatgtgctttactaagccatcgcgatggagcaaaagtatgtttaggtacacgctggacagaacaaatgtatgaaactgctgaaaatcaattagcctttttatgccaacaaggtttttcactagagaatgcattatatgcaatgagtgctgtgagggtgtttactttaggttgcgtattgtttgatcaagagctccaagtcgctaaagaagaaagggaaacacctactactgctagtatgccgccattattgcgacaagtttgggaattaaaggatcaccaaggtgcagagccagccttcttattcggccttgaattgatcatatgcggattagaaaaacaacttaaatgcgaaagtgggtcttaa

SEQ ID NO: 512 - DNA, 627 bp, Artificial sequence
  SuR L6-3C06 CDS
atgggatctagattagataaaagtaaagtgattaacagcgcattagagctgcttaatgaggtcggaatcgaaggtttaacaacccgtaaactcgcccagaagctaggtgtagagcagcctacattgtattggcatgtaaaaaataagcgagctctgctcgacgccttagccattgagatgatggataggcaccaaactcacatttgccctttagaaggggaaagctggcaagattttttacgtaataatgctaaaagtatgagatgtgctttactaagccatcgcgatggagcaaaagtatgtttaggtacacgctggacagaaaaacattatgaaactgctgaaaatatgttagcctttttatgccaacaaggtttttcactagagaatgcattatatgcaatgagtgctgtgagggtgtttactttaggttgcgtattgtttgatcaagagagccaagtcgctaaagaagaaagggaaacacctactactgctagtatgccgccattagtgcgacaagtttgggaattaaaggatcaccaaggtgcagagccagccttcttattcggccttgaattgatcatatgcggattagaaaaacaacttaaatgcgaaagtgggtcttaa

SEQ ID NO: 513 - DNA, 627 bp, Artificial sequence
  SuR L6-3D03 CDS
atgggatctagattagataaaagtaaagtgattaacagcgcattagagctgcttaatgaggtcggaatcgaaggtttaacaacccgtaaactcgcccagaagctaggtgtagagcagcctacattgtattggcatgtaaaaaataagcgagctctgctcgacgccttagccattgagatgatggataggcaccaaactcacgtttgccctttagaaggggaaagctggcaagattttttacgtaatactgctaaaagtatgagatgtgctttactaagccatcgcgatggagcaaaagtatgtttaggtacacgctggacagaacaattgtatgaaactgctgaaaatatgttagcctttttatgccaacaaggtttttcactagagaatgcattatatgcagtgagtgctgtgagggtgtttactttaggttgcgtattgtttgatcaagagagccaagtcgctaaagaagaaagggaaacacctactactgctaggatgccgccattattgcgacaaggttgggaattaaaggatcaccaaggtgcagagccagccttcttattcggccttgaattgatcatatgcggattagaaaaacaacttaaatgcgaaagtgggtcttaa

SEQ ID NO: 514 - DNA, 627 bp, Artificial sequence
  SuR L6-3D05 CDS
atgggatctagattagataaaagtaaagtgattaacagcgcattagagctgcttaatgaggtcggaatcgaaggtttaacaacccgtaaactcgcccagaagctaggtgtagagcagcctacattgtattggcatgtaaaaaataagcgagctctgctcgacgccttagccattgagatgatggataggcaccaaactcactattgccctttagaaggggaaagctggcaagattttttacgtaatactgctaaaagtatgagatgtgctttactaagccatcgcgatggagcaaaagtatgtttaggtacacgctggacagaacaattgtatgaaagtgctgaaaatatgttagcctttttatgccaacaaggtttttcactagagaatgcattatatgcaatgagtgctgtgagggtgtttactttaggttgcgtattgtttgatcaagagctccaagtcgctaaagaagaaagggaaacacctactactgctagtatgccgccattattgcgacaaggttgggaattaaaggatcaccaaggtgcagagccagccttcttattcggccttgaattgatcatatgcggattagaaaaacaacttaaatgcgaaagtgggtcttaa

SEQ ID NO: 515 - DNA, 627 bp, Artificial sequence
  SuR L6-3D09 CDS
atgggatctagattagataaaagtaaagtgattaacagcgcattagagctgcttaatgaggtcggaatcgaaggtttaacaacccgtaaactcgcccagaagctaggtgtagagcagcctacattgtattggcatgtaaaaaataagcgagctctgctcgacgccttagccattgagatgatggataggcaccaaactcactattgccctttagaaggggaaagctggcaagattttttacgtaatactgctaaaagtatgagatgtgctttactaagccatcgcgatggagcaaaagtatgtttaggtacacgctggacagaaaaacaatatgaaactgctgaaaatcaattagcctttttatgccaacaaggtttttcactagagaatgcattatatgcagtgagtgctgtgagggtgtttactttaggttgcgtattgtttgatcaagagagccaagtcgctaaagaagaaagggaaacacctactactgctagtatgccgccattagtgcgacaagtttgggaattaaaggatcaccaaggtgcagagccagccttcttattcggccttgaattgatcatatgcggattagaaaaacaacttaaatgcgaaagtgggtcttaa

SEQ ID NO: 516 - DNA, 627 bp, Artificial sequence
  SuR L6-3E08 CDS
atgggatctagattagataaaagtaaagtgattaacagcgcattagagctgcttaatgaggtcggaatcgaaggtttaacaacccgtaaactcgcccagaagctaggtgtagagcagcctacattgtattggcatgtaaaaaataagcgagctctgctcgacgccttagccattgagatgatggataggcacgcaactcactattgccctttagaaggggaaagctggcaagattttttacgtaataatgctaaaagtatgagatgtgctttactaagccatcgcgatggagcaaaagtatgtttaggtacacgctggacagaacaacattatgaaactgctgaaaatcaattagcctttttatgccaacaaggtttttcactagagaatgcattatatgcaatgagtgctgtgagggtgtttactttaggttgcgtattgtttgatcaagagagccaagtcgctaaagaagaaagggaaacacctactactgctagtatgccgccattagtgcgacaaggttgggaattaaaggatcaccaaggtgcagagccagccttcttattcggccttgaattgatcatatgcggattagaaaaacaacttaaatgcgaaagtgggtcttaa

SEQ ID NO: 517 - DNA, 627 bp, Artificial sequence
  SuR L6-3E09 CDS
atgggatctagattagataaaagtaaagtgattaacagcgcattagagctgcttaatgaggtcggaatcgaaggtttaacaacccgtaaactcgcccagaagctaggtgtagagcagcctacattgtattggcatgtaaaaaataagcgagctctgctcgacgccttagccattgagatgatggataggcaccaaactcactattgccctttagaaggggaaagctggcaagattttttacgtaataatgctaaaagtatgagatgtgctttactaagccatcgcgatggagcaaaagtatgtttaggtacacgctggacagaaaaacattatgaaactgctgaaaatcaattagcctttttatgccaacaaggtttttcactagagaatgcattatatgcaatgagtgctgtgagggtgtttactttaggttgcgtattgtttgatcaagagagccaagtcgctaaagaagaaagggaaacacctactactgctagtatgccgccattattgcgacaagcttgggaattaaaggatcaccaaggtgcagagccagccttcttattcggccttgaattgatcatatgcggattagaaaaacaacttaaatgcgaaagtgggtcttaa

SEQ ID NO: 518 - DNA, 627 bp, Artificial sequence
  SuR L6-3E10 CDS
atgggatctagattagataaaagtaaagtgattaacagcgcattagagctgcttaatgaggtcggaatcgaaggtttaacaacccgtaaactcgcccagaagctaggtgtagagcagcctacattgtattggcatgtaaaaaataagcgagctctgctcgacgccttagccattgagatgatggataggcaccaaactcactattgccctttagaaggggaaagctggcaagattttttacgtaataatgctaaaagtatgagatgtgctttactaagccatcgcgatggagcaaaagtatgtttaggtacacgctggacagaacaacattatgaagctgctgaaaatatgttagcctttttatgccaacaaggtttttcactagagaatgcattatatgcagtgagtgctgtgagggtgtttactttaggttgcgtattgtttgatcaagagagccaagtcgctaaagaagaaagggaaacacctactactgctagtatgccgccattattgcgacaagtttgggaattaaaggatcaccaaggtgcagagccagccttcttattcggccttgaattgatcatatgcggattagaaaaacaacttaaatgcgaaagtgggtcttaa

SEQ ID NO: 519 - DNA, 627 bp, Artificial sequence
  SuR L6-3F02 CDS
atgggatctagattagataaaagtaaagtgattaacagcgcattagagctgcttaatgaggtcggaatcgaaggtttaacaacccgtaaactcgcccagaagctaggtgtagagcagcctacattgtattggcatgtaaaaaataagcgagctctgctcgacgccttagccattgagatgatggataggcaccaaactcactattgccctttagaaggggaaagctggcaagattttttacgtaataatgctaaaagtatgagatgtgctttactaagccatcgcgatggagcaaaagtatgtttaggtacacgctggacagaacaaatgtatgaagctgctgaaaatcaattagcctttttatgccaacaaggtttttcactagagaatgcattatatgcagtgagtgctgtgagggtgtttactttaggttgcgtattgtttgatcaagagctccaagtcgctaaagaagaaagggaaacacctactactgctagtatgccgccattagtgcgacaagtttgggaattaaaggatcaccaaggtgcagagccagccttcttattcggccttgaattgatcatatgcggattagaaaaacaacttaaatgcgaaagtgggtcttaa

SEQ ID NO: 520 - DNA, 627 bp, Artificial sequence
  SuR L6-3F09 CDS
atgggatctagattagataaaagtaaagtgattaacagcgcattagagctgcttaatgaggtcggaatcgaaggtttaacaacccgtaaactcgcccagaagctaggtgtagagcagcctacattgtattggcatgtaaaaaataagcgagctctgctcgacgccttagccattgagatgatggataggcaccaaactcactattgccctttagaaggggaaagctggcaagattttttacgtaataatgctaaaagtatgagatgtgctttactaagccatcgcgatggagcaaaagtatgtttaggtacacgctggacagaaaaattgtatgaagctgctgaaaatatgttagcctttttatgccaacaaggtttttcactagagaatgcattatatgcagtgagtgctgtgagggtgtttactttaggttgcgtattgtttgatcaagagagccaagtcgctaaagaagaaagggaaacacctactactgctagtatgccgccattagtgcgacaagtttgggaattaaaggatcaccaaggtgcagagccagccttcttattcggccttgaattgatcatatgcggattagaaaaacaacttaaatgcgaaagtgggtcttaa

SEQ ID NO: 521 - DNA, 627 bp, Artificial sequence
  SuR L6-3F12 CDS
  misc_feature (418)..(419): n is a, c, g, or t
atgggatctagattagataaaagtaaagtgattaacagcgcattagagctgcttaatgaggtcggaatcgaaggtttaacaacccgtaaactcgcccagaagctaggtgtagagcagcctacattgtattggcatgtaaaaaataagcgagctctgctcgacgccttagccattgagatgatggataggcaccaaactcactattgccctttagaaggggaaagctggcaagattttttacgtaatactgctaaaagtatgagatgtgctttactaagccatcgcgatggagcaaaagtatgtttaggtacacgctggacagaacaaatgtatgaagctgctgaaaatatgttagcctttttatgccaacaaggtttttcactagagaatgcattatatgcaatgagtgctgtgaggnngtttactttaggttgcgtattgtttgatcaagagagccaagtcgctaaagaagaaagggaaacacctactactgctagtatgccgccattagtgcgacaagcttgggaattaaaggatcaccaaggtgcagagccagccttcttattcggccttgaattgatcatatgcggattagaaaaacaacttaaatgcgaaagtgggtcttaa

SEQ ID NO: 522 - DNA, 627 bp, Artificial sequence
  SuR L6-3G03 CDS
  misc_feature (219)..(219): n is a, c, g, or t
  misc_feature (337)..(337): n is a, c, g, or t
  misc_feature (418)..(418): n is a, c, g, or t
atgggatctagattagataaaagtaaagtgattaacagcgcattagagctgcttaatgaggtcggaatcgaaggtttaacaacccgtaaactcgcccagaagctaggtgtagagcagcctacattgtattggcatgtaaaaaataagcgagctctgctcgacgccttagccattgagatgatggataggcacgcaactcactattgccctttagaaggngaaagctggcaagattttttacgtaataatgctaaaagtatgagatgtgctttactaagccatcgcgatggagcaaaagtatgtttaggtacacgctggacagaacaactgtatgaanctgctgaaaatcaattagcctttttatgccaacaaggtttttcactagagaatgcattatatgcaatgagtgctgtgaggnwgtttactttaggttgcgtattgtttgatcaagagagccaagtcgctaaagaagaaagggaaacacctactactgctagtatgccgccattagtgcgacaaggttgggaattaaaggatcaccaaggtgcagagccagccttcttattcggccttgaattgatcatatgcggattagaaaaacaacttaaatgcgaaagtgggtcttaa

SEQ ID NO: 523 - DNA, 627 bp, Artificial sequence
  SuR L6-3G05 CDS
atgggatctagattagataaaagtaaagtgattaacagcgcattagagctgcttaatgaggtcggaatcgaaggtttaacaacccgtaaactcgcccagaagctaggtgtagagcagcctacattgtattggcatgtaaaaaataagcgagctctgctcgacgccttagccattgagatgatggataggcaccaaactcactattgccctttagaaggggaaagctggcaagattttttacgtaatactgctaaaagtatgagatgtgctttactaagccatcgcgatggagcaaaagtatgtttaggtacacgctggacagaaaaacaatatgaaagtgctgaaaatcaattagcctttttatgccaacaaggtttttcactagagaatgcattatatgcaatgagtgctgtgagggtgtttactttaggttgcgtattgtttgatcaagagagccaagtcgctaaagaagaaagggaaacacctactactgctagtatgccgccattagtgcgacaaggttgggaattaaaggatcaccaaggtgcagagccagccttcttattcggccttgaattgatcatatgcggattagaaaaacaacttaaatgcgaaagtgggtcttaa

SEQ ID NO: 524 - DNA, 627 bp, Artificial sequence
  SuR L6-3G09 CDS
atgggatctagattagataaaagtaaagtgattaacagcgcattagagctgcttaatgaggtcggaatcgaaggtttaacaacccgtaaactcgcccagaagctaggtgtagagcagcctacattgtattggcatgtaaaaaataagcgagctctgctcgacgccttagccattgagatgatggataggcaccaaactcactattgccctttagaaggggaaagctggcaagattttttacgtaataatgctaaaagtatgagatgtgctttactaagccatcgcgatggagcaaaagtatgtttaggtacacgctggacagaacaacattatgaagctgctgaaaatcaattagcctttttatgccaacaaggtttttcactagagaatgcattatatgcagtgagtgctgtgagggtgtttactttaggttgcgtattgtttgatcaagagagccaagtcgctaaagaagaaagggaaacacctactactgctagtatgccgccattagtgcgacaagtttgggaattaaaggatcaccaaggtgcagagccagccttcttattcggccttgaattgatcatatgcggattagaaaaacaacttaaatgcgaaagtgggtcttaa

SEQ ID NO: 525 - DNA, 627 bp, Artificial sequence
  SuR L6-3H02 CDS
atgggatctagattagataaaagtaaagtgattaacagcgcattagagctgcttaatgaggtcggaatcgaaggtttaacaacccgtaaactcgcccagaagctaggtgtagagcagcctacattgtattggcatgtaaaaaataagcgagctctgctcgacgccttagccattgagatgatggataggcacgcaactcactattgccctttagaaggggaaagctggcaagattttttacgtaatactgctaaaagtatgagatgtgctttactaagccatcgcgatggagcaaaagtatgtttaggtacacgctggacagaacaacattatgaaagtgctgaaaatatgttagcctttttatgccaacaaggtttttcactagagaatgcattatatgcagtgagtgctgtgagggtgtttactttaggttgcgtattgtttgatcaagagagccaagtcgctaaagaagaaagggaaacacctactactgctagtatgccgccattagtgcgacaagcttgggaattaaaggttcaccaaggtgcagagccagccttcttattcggccttgaattgatcatatgcggattagaaaaacaacttaaatgcgaaagtgggtcttaa

SEQ ID NO: 526 - DNA, 627 bp, Artificial sequence
  SuR L6-3H05 CDS
atgggatctagattagataaaagtaaagtgattaacagcgcattagagctgcttaatgaggtcggaatcgaaggtttaacaacccgtaaactcgcccagaagctaggtgtagagcagcctacattgtattggcatgtaaaaaataagcgagctctgctcgacgccttagccattgagatgatggataggcacgcaactcactattgccctttagaaggggaaagctggcaagattttttacgtaataatgctaaaagtatgagatgtgctttactaagccatcgcgatggagcaaaagtatgtttaggtacacgctggacagaacaacattatgaaagtgctgaaaatcaattagcctttttatgccaacaaggtttttcactagagaatgcattatatgcagtgagtgctgtgagggtgtttactttaggttgcgtattgtttgatcaagagctccaagtcgctaaagaagaaagggaaacacctactactgctagtatgccgccattattgcgacaagtttgggaattaaaggatcaccaaggtgcagagccagccttcttattcggccttgaattgatcatatgcggattagaaaaacaacttaaatgcgaaagtgggtcttaa

SEQ ID NO: 527 - DNA, 627 bp, Artificial sequence
  SuR L6-3H08 CDS
atgggatctagattagataaaagtaaagtgattaacagcgcattagagctgcttaatgaggtcggaatcgaaggtttaacaacccgtaaactcgcccagaagctaggtgtagagcagcctacattgtattggcatgtaaaaaataagcgagctctgctcgacgccttagccattgagatgatggataggcacgcaactcactattgccctttagaaggggaaagctggcaagattttttacgtaatactgctaaaagtatgagatgtgctttactaagccatcgcgatggagcaaaagtatgtttaggtacacgctggacagaaaaacaatatgaagctgctgaaaatcaattagcctttttatgccaacaaggtttttcactagagaatgcattatatgcagtgagtgctgtggggaactttactttaggttgcgtattgtttgatcaagagctccaagtcgctaaagaagaaagggaaacacctactactgctagtatgccgccattagtgcgacaagctttggaattaaaggatcaccaaggtgcagagccagccttcttattcggccttgaattgatcatatgcggattagaaaaacaacttaaatgcgaaagtgggtcttaa

SEQ ID NO: 528 - DNA, 627 bp, Artificial sequence
  SuR L6-4A01 CDS
atgggatctagattagataaaagtaaagtgattaacagcgcattagagctgcttaatgaggtcggaatcgaaggtttaacaacccgtaaactcgcccagaagctaggtgtagagcagcctacattgtattggcatgtaaaaaataagcgagctctgctcgacgccttagccattgagatgatggataggcacgcaactcactattgccctttagaaggggaaagctggcaagattttttacgtaatactgctaaaagtatgagatgtgctttactaagccatcgcgatggagcaaaagtatgtttaggtacacgctggacagaacaacaatatgaaactgctgaaaatcaattagcctttttatgccaacaaggtttttcactagagaatgcattatatgcaatgagtgctgtgaggaactttactttaggttgcgtattgtttgatcaagagagccaagtcgctaaagaagaaagggaaacacctactactgctagtatgccgccattattgcgacaagcttgggaattaaaggatcaccaaggtgcagagccagccttcttattcggccttgaattgatcatatgcggattagaaaaacaacttaaatgcgaaagtgggtcttaa

SEQ ID NO: 529 - DNA, 627 bp, Artificial sequence
  SuR L6-4A03 CDS
  misc_feature (200)..(200): n is a, c, g, or t
  misc_feature (314)..(314): n is a, c, g, or t
  misc_feature (368)..(368): n is a, c, g, or t
  misc_feature (413)..(413): n is a, c, g, or t
  misc_feature (437)..(437): n is a, c, g, or t
  misc_feature (458)..(458): n is a, c, g, or t
  misc_feature (542)..(542): n is a, c, g, or t
atgggatctagattagataaaagtaaagtgattaacagcgcattagagctgcttaatgaggtcggaatcgaaggtttaacaacccgtaaactcgcccagaagctaggtgtagagcagcctacattgtattggcatgtaaaaaataagcgagctctgctcgacgccttagccattgagatgatggataggcacgcaactcnctattgccctttagaaggggaaagctggcaagattttttacgtaataatgctaaaagtatgagatgtgctttactaagccatcgcgatggagcaaaagtatgtttaggtacacnctggacagaaaaacattatgaaactgctgaaaatcaattagcctttttatgccnacaaggtttttcactagagaatgcattatatgcaatgagtgctgngagggtgtttactttaggttgcgnattgtttgatcaagagctccnagtcgctaaagaagaaagggaaacacctactactgctagtatgccgccattattgcgacaaggttgggaattaaaggatcaccnaggtgcagagccagccttcttattcggccttgaattgatcatatgcggattagaaaaacaacttaaatgcgaaagtgggtcttaa

SEQ ID NO: 530 - DNA, 627 bp, Artificial sequence
  SuR L6-4A04 CDS
atgggatctagattagataaaagtaaagtgattaacagcgcattagagctgcttaatgaggtcggaatcgaaggtttaacaacccgtaaactcgcccagaagctaggtgtagagcagcctacattgtattggcatgtaaaaaataagcgagctctgctcgacgccttagccattgagatgatggataggcaccaaactcacttgtgccctttagaaggggaaagctggcaagattttttacgtaatactgctaaaagtatgagatgtgctttactaagccatcgcgatggagcaaaagtatgtttaggtacacsctggacagaaaaaatgtatgaaagtgctgaaaatatgttagcctttttatgccaacaaggtttttcactagagaatgcattatatgcagtgagtgctgtgagggtgtttactttaggttgcgtattgtttgatcaagagctccaagtcgctaaagaagaaagggaaacacctactactgctagtatgccgccattattgcgacaagtttgggaattaaaggatcaccaaggtgcagagccagccttcttattcggccttgaattgatcatatgcggattagaaaaacaacttaaatgcgaaagtgggtcttaa

SEQ ID NO: 531 - DNA, 627 bp, Artificial sequence
  SuR L6-4A09 CDS
atgggatctagattagataaaagtaaagtgattaacagcgcattagagctgcttaatgaggtcggaatcgaaggtttaacaacccgtaaactcgcccagaagctaggtgtagagcagcctacattgtattggcatgtaaaaaataagcgagctctgctcgacgccttagccattgagatgatggataggcaccaaactcacatgtgccctttagaaggggaaagctggcaagattttttacgtaataatgctaaaagtatgagatgtgctttactaagccatcgcgatggagcaaaagtatgtttaggtacacgctggacagaaaaaatgtatgaaagtgctgaaaatatgttagcctttttatgccaacaaggtttttcactagagaatgcattatatgcaatgagtgctgtgagggtgtttactttaggttgcgtattgtttgatcaagagagccaagtcgctaaagaagaaagggaaacacctactwctrctagtatgycgccattagtgcgacaagcttgggaattaaaggatcaccaaggtgcagagccagccttcttattcggccttgaattgatcatatgcggattagaaaaacaacttaaatgcgaaagtgggtcttaa

SEQ ID NO: 532 - DNA, 627 bp, Artificial Sequence
  SuR L6-4A10 CDS
atgggatctagattagataaaagtaaagtgattaacagcgcattagagctgcttaatgaggtcggaatcgaaggtttaacaacccgtaaactcgcccagaagctaggtgtagagcagcctacattgtattggcatgtaaaaaataagcgagctctgctcgacgccttagccattgagatgatggataggcacgcaactcacatttgccctttagaaggggaaagctggcaagattttttacgtaatactgctaaaagtatgagatgtgctttactaagccatcgcgatggagcaaaagtatgtttaggtacacgctggacagaacaacattatgaaagtgctgaaaatcaattagcctttttatgccaacaaggtttttcactagagaatgcattatatgcagtgagtgctgtgagggtgtttactttaggttgcgtattgtttgatcaagagagccaagtcgctaaagaagaaagggaaacacctactactgctagtatgccgccattattgcgacaagtttgggaattaaaggatcaccaaggtgcagagccagccttcttattcggccttgaattgatcatatgcggattagaaaaacaacttaaatgcgaaagtgggtcttaa

SEQ ID NO: 533 - DNA, 627 bp, Artificial sequence
  SuR L6-4A11 CDS
  misc_feature (303)..(303): n is a, c, g, or t
  misc_feature (329)..(330): n is a, c, g, or t
  misc_feature (512)..(512): n is a, c, g, or t
atgggatctagattagataaaagtaaagtgattaacagcgcattagagctgcttaatgaggtcggaatcgaaggtttaacaacccgtaaactcgcccagaagctaggtgtagagcagcctacattgtattggcatgtaaaaaataagcgagctctgctcgacgccttagccattgagatgatggataggcaccaaactcactattgccctttagaaggggaaagctggcaagattttttacgtaatactgctaaaagtatgagatgtgctttactaagccatcgcgatggagcaaaagtatgnttaggtacacgctggacagaaaaacnntatgaagstgctgaaaatcaattagcctttttatgccaacaaggtttttcactagagaatgcattatatgcaatsagtgctgtgagggtgtttactttaggttgcgtattgtttgatcaagagagccaagtcgctaaagaagaaagggaaacacctactactgctagtatgccgccattagnscgacaagkttgggaattaaaggatcaccaaggtgcagagccagccttcttattcggccttgaattgatcatatgcggattagaaaaacaacttaaatgcgaaagtgggtcttaa

SEQ ID NO: 534 - DNA, 627 bp, Artificial sequence
  SuR L6-4B05 CDS
  misc_feature (194)..(194): n is a, c, g, or t
  misc_feature (204)..(204): n is a, c, g, or t
  misc_feature (418)..(419): n is a, c, g, or t
  misc_feature (521)..(521): n is a, c, g, or t
atgggatctagattagataaaagtaaagtgattaacagcgcattagagctgcttaatgaggtcggaatcgaaggtttaacaacccgtaaactcgcccagaagctaggtgtagagcagcctacattgtattggcatgtaaaaaataagcgagctctgctcgacgccttagccattgagatgatggataggcaccnaactcactantgccctttagaaggggaaagctggcaagattttttacgtaatactgctaaaagtatgagatgtgctttactaagccatcgcgatggagcaaaagtatgtttaggtacacgctggacagaacaacattatgaagctgctgaaaatctgttagcctttttatgccaacaaggtttttcactagagaatgcattatatgcaatgagtgctgtgaggnngtttactttaggttgcgtattgtttgatcaagagctccaagtcgctaaagaagaaagggaaacacctactactgctagtatkccgccattagtgcgacaagnttgggaattaaaggatcaccaaggtgcagagccagccttcttattcggccttgaattgatcatatgcggattagaaaaacaacttaaatgcgaaagtgggtcttaa

SEQ ID NO: 535 - DNA, 627 bp, Artificial sequence
  SuR L6-4B06 CDS
atgggatctagattagataaaagtaaagtgattaacagcgcattagagctgcttaatgaggtcggaatcgaaggtttaacaacccgtaaactcgcccagaagctaggtgtagagcagcctacattgtattggcatgtaaaaaataagcgagctctgctcgacgccttagccattgagatgatggataggcacgcaactcacgtttgccctttagaaggggaaagctggcaagattttttacgtaataatgctaaaagtatgagatgtgctttactaagccatcgcgatggagcaaaagtatgtttaggtacacgctggacagaacaacaatatgaaactgctgaaaatatgttagcctttttatgccaacaaggtttttcactagagaatgcattatatgcagtgagtgctgtgaggaactttactttaggttgcgtattgtttgatcaagagagccaagtcgctaaagaagaaagggaaacacctactactgctagtatgccgccattattgcgacaaggttgggaattaaaggatcaccaaggtgcagagccagccttcttattcggccttgaattgatcatatgcggattagaaaaacaacttaaatgcgaaagtgggtcttaa

SEQ ID NO: 536 - DNA, 627 bp, Artificial sequence
  SuR L6-4B07 CDS
atgggatctagattagataaaagtaaagtgattaacagcgcattagagctgcttaatgaggtcggaatcgaaggtttaacaacccgtaaactcgcccagaagctaggtgtagagcagcctacattgtattggcatgtaaaaaataagcgagctctgctcgacgccttagccattgagatgatggataggcacgcaactcactattgccctttagaaggggaaagctggcaagattttttacgtaataatgctaaaagtatgagatgtgctttactaagccatcgcgatggagcaaaagtatgtttaggtacacgctggacagaacaacattatgaaactgctgaaaatatgttagcctttttatgccaacaaggtttttcactagagaatgcattatatgcagtgagtgctgtgaggaactttactttaggttgcgtattgtttgatcaagagctccaagtcgctaaagaagaaagggaaacacctactactgctagtatgccgccattagtgcgacaagcttgggaattaaaggatcaccaaggtgcagagccagccttcttattcggccttgaattgatcatatgcggattagaaaaacaacttaaatgcgaaagtgggtcttaa

SEQ ID NO: 537 - DNA, 627 bp, Artificial sequence
  SuR L6-4B08 CDS
atgggatctagattagataaaagtaaagtgattaacagcgcattagagctgcttaatgaggtcggaatcgaaggtttaacaacccgtaaactcgcccagaagctaggtgtagagcagcctacattgtattggcatgtaaaaaataagcgagctctgctcgacgccttagccattgagatgatggataggcaccaaactcacttttgccctttagaaggggaaagctggcaagattttttacgtaataatgctaaaagtatgagatgtgctttactaagccatcgcgatggagcaaaagtatgtttaggtacacgctggacagaacaaatgtatgaaactgctgaaaatatgttagcctttttatgccaacaaggtttttcactagagaatgcattatatgcaatgagtgctgtgagggtgtttactttaggttgcgtattgtttgatcaagagagccaagtcgctaaagaagaaagggaaacacctactactgctagtatgcccccattagtgcgacaaggttgggaattaaaggatcaccaaggtgcagagccagccttcttattcggccttgaattgatcatatgcggattagaaaaacaacttaaatgcgaaagtgggtcttaa

SEQ ID NO: 538 - DNA, 627 bp, Artificial sequence
  SuR L6-4B12 CDS
atgggatctagattagataaaagtaaagtgattaacagcgcattagagctgcttaatgaggtcggaatcgaaggtttaacaacccgtaaactcgcccagaagctaggtgtagagcagcctacattgtattggcatgtaaaaaataagcgagctctgctcgacgccttagccattgagatgatggataggcacgcaactgactattgccctttagaaggggaaagctggcaagattttttacgtaataatgctaaaagtatgagatgtgctttactaagccatcgcgatggagcaaaagtatgtttaggtacacgctggacagaaaaacaatatgaaactgctgaaaatatgttagcctttttatgccaacaaggtttttcactagagaatgcattatatgcagtgagtgctgtgagggtgtttactttaggttgcgtattgtttgatcaagagagccaagtcgctwaagaagaaagggaaacacctmctactgctagtatrccgccattagtgcgacaagtttgggaattaaaggatcaccaaggtgcagagccagccttcttattcggccttgaattgatcatatgcggattagaaaaacaacttaaatgcgaaagtgggtcttaa

SEQ ID NO: 539 - DNA, 627 bp, Artificial sequence
  SuR L6-4C01 CDS
atgggatctagattagataaaagtaaagtgattaacagcgcattagagctgcttaatgaggtcggaatcgaaggtttaacaacccgtaaactcgcccagaagctaggtgtagagcagcctacattgtattggcatgtaaaaaataagcgagctctgctcgacgccttagccattgagatgatggataggcaccaaactcactattgccctttagaaggggaaagctggcaagattttttacgtaataatgctaaaagtatgagatgtgctttactaagccatcgcgatggagcaaaagtatgtttaggtacacgctggacagaacaattgtatgaaactgctgaaaatcaattagcctttttatgccaacaaggtttttcactagagaatgcattatatgcaatgagtgctgtgagggtgtttactttaggttgcgtattgtttgatcaagagagccaagtcgctaaagaagaaagggaaacacctactactgctagtatgccgccattagtgcgacaagcttgggaattaaaggatcaccaaggtgcagagccagccttcttattcggccttgaattgatcatatgcggattagaaaaacaacttaaatgcgaaagtgggtcttaa

SEQ ID NO: 540 - DNA, 627 bp, Artificial sequence
  SuR L6-4C03 CDS
atgggatctagattagataaaagtaaagtgattaacagcgcattagagctgcttaatgaggtcggaatcgaaggtttaacaacccgtaaactcgcccagaagctaggtgtagagcagcctacattgtattggcatgtaaaaaataagcgagctctgctcgacgccttagccattgagatgatggataggcaccaaactcacgtgtgccctttagaaggggaaagctggcaagattttttacgtaataatgctaaaagtatgagatgtgctttactaagccatcgcgatggagcaaaagtatgtttaggtacacgctggacagaacaacattatgaagctgctgaaaatatgttagcctttttatgccaacaaggtttttcactagagaatgcattatatkcaatgagtgctgtgagggtgtttactttaggttgcgtattgtttgatcaagagctccaagtcgctaaagaagaaagggaaacacctactactgctagtatgccgccattagtgcgacaagcttgggaattaaaggatcaccaaggtgcagagccagccttcttattcggccttgaattgatcatatgcggattagaaaaacaacttaaatgcgaaagtgggtcttaa

SEQ ID NO: 541 - DNA, 627 bp, Artificial sequence
  SuR L6-4C04 CDS
atgggatctagattagataaaagtaaagtgattaacagcgcattagagctgcttaatgaggtcggaatcgaaggtttaacaacccgtaaactcgcccagaagctaggtgtagagcagcctacattgtattggcatgtaaaaaataagcgagctctgctcgacgccttagccattgagatgatggataggcaccaaactcacttttgccctttagaaggggaaagctggcaagattttttacgtaataatgctaaaagtatgagatgtgctttactaagccatcgcgatggagcaaaagtatgtttaggtacacgctggacagaacaacaatatgaaagtgctgaaaatcaattagcctttttatgccaacaaggtttttcactagagaatgcattatatgcaatgagtgctgtgagggtgtttactttaggttgcgtattgtttgatcaagagagccaagtcgctaaagaagaaagggaaacacctactactgctagtatgccgccattattgcgacaaggtttggaattaaaggatcaccaaggtgcagagccagccttcttattcggccttgaattgatcatatgcggattagaaaaacaacttaaatgcgaaagtgggtcttaa

SEQ ID NO: 542 - DNA, 627 bp, Artificial sequence
  SuR L6-4C07 CDS
atgggatctagattagataaaagtaaagtgattaacagcgcattagagctgcttaatgaggtcggaatcgaaggtttaacaacccgtaaactcgcccagaagctaggtgtagagcagcctacattgtattggcatgtaaaaaataagcgagctctgctcgacgccttagccattgagatgatggataggcaccaaactcacttgtgccctttagaaggggaaagctggcaagattttttacgtaataatgctaaaagtatgagatgtgctttactaagccatcgcgatggagcaaaagtatgtttaggtacacgctggacagaacaattgtatgaaactgctgaaaatatgttagcctttttatgccaacaaggtttttcactagagaatgcattatatgcaatgagtgctgtgagggtgtttactttaggttgcgtattgtttgatcaagagagccaagtcgctaaagaagaaagggaaacacctactactgctagtatgccgccattattgcgacaaggttgggaattaaaggatcaccaaggtgcagagccagccttcttattcggccttgaattgatcatatgcggattagaaaaacaacttaaatgcgaaagtgggtcttaa

SEQ ID NO: 543 - DNA, 627 bp, Artificial sequence
  SuR L6-4C08 CDS
atgggatctagattagataaaagtaaagtgattaacagcgcattagagctgcttaatgaggtcggaatcgaaggtttaacaacccgtaaactcgcccagaagctaggtgtagagcagcctacattgtattggcatgtaaaaaataagcgagctctgctcgacgccttagccattgagatgatggataggcaccaaactcactattgccctttagaaggggaaagctggcaagattttttacgtaatactgctaaaagtatgagatgtgctttactaagccatcgcgatggagcaaaagtatgtttaggtacacgctggacagaaaaattgtatgaaactgctgaaaatatgttagcctttttatgccaacaaggtttttcactagagaatgcattatatgcaatgagtgctgtgagggtgtttactttaggttgcgtattgtttgatcaagagagccaagtcgctaaagaagaaagggaaacacctactactgctagtatgccgccattattgcgacaagcttgggaattaaaggatcaccaaggtgcagagccagccttcttattcggccttgaattgatcatatgcggattagaaaaacaacttaaatgcgaaagtgggtcttaa

SEQ ID NO: 544 - DNA, 627 bp, Artificial sequence
  SuR L6-4C09 CDS
atgggatctagattagataaaagtaaagtgattaacagcgcattagagctgcttaatgaggtcggaatcgaaggtttaacaacccgtaaactcgcccagaagctaggtgtagagcagcctacattgtattggcatgtaaaaaataagcgagctctgctcgacgccttagccattgagatgatggataggcaccaaactcactattgccctttagaaggggaaagctggcaagattttttacgtaataatgctaaaagtatgagatgtgctttactaagccatcgcgatggagcaaaagtatgtttaggtacacgctggacagaaaaacaatatgaaactgctgaaaatatgttagcctttttatgccaacaaggtttttcactagagaatgcattatatgcaatgagtgctgtgagggtgtttactttaggttgcgtattgtttgatcaagagctccaagtcgctaaagaagaaagggaaacacctactactgctagtatgccgccattattgcgacaagtttgggaattaaaggatcaccaaggtgcagagccagccttcttattcggccttgaattgatcatatgcggattagaaaaacaacttaaatgcgaaagtgggtcktaa

SEQ ID NO: 545 - DNA, 627 bp, Artificial sequence
  SuR L6-4C10 CDS
atgggatctagattagataaaagtaaagtgattaacagcgcattagagctgcttaatgaggtcggaatcgaaggtttaacaacccgtaaactcgcccagaagctaggtgtagagcagcctacattgtattggcatgtaaaaaataagcgagctctgctcgacgccttagccattgagatgatggataggcaccaaactcactattgccctttagaaggggaaagctggcaagattttttacgtaatactgctaaaagtatgagatgtgctttactaagccatcgcgatggagcaaaagtatgtttaggtacacgctggacagaacaaatgtatgaaagtgctgaaaatcaattagcctttttatgccaacaaggtttttcactagagaatgcattatatgcagtgagtgctgtgagggtgtttactttaggttgcgtattgtttgatcaagagctccaagtcgctaaagaagaaagggaaacacctactactgctagtatgccgccattattgcgacaagcttgggaattaaaggatcaccaaggtgcagagccagccttcttattcggccttgaattgatcatatgcggattagaaaaacaacttaaatgcgaaagtgggtcttaa

SEQ ID NO: 546 - DNA, 627 bp, Artificial sequence
  SuR L6-4C11 CDS
atgggatctagattagataaaagtaaagtgattaacagcgcattagagctgcttaatgaggtcggaatcgaaggtttaacaacccgtaaactcgcccagaagctaggtgtagagcagcctacattgtattggcatgtaaaaaataagcgagctctgctcgacgccttagccattgagatgatggataggcaccaaactcactattgccctttagaaggggaaagctggcaagattttttacgtaatactgctaaaagtatgagatgtgctttactaagccatcgcgatggagcaaaagtatgtttaggtacacgctggacagaaaaacaatatgaaactgctgaaaatatgttagcctttttatgccaacaaggtttttcactagagaatgcattatatgcaatgagtgctgtgagggtgtttactttaggttgcgtattgtttgatcaagagagccaagtcgctaaagaagaaagggaaacacctactactgctagtatgccgccattattgcgacaaggttgggaattaaaggatcaccaaggtgcagagccagccttcttattcggccttgaattgatcatatgcggattagaaaaacaacttaaatgcgaaagtgggtcttaa

SEQ ID NO: 547 - DNA, 627 bp, Artificial sequence; identical to SEQ ID NO: 519
  SuR L6-4D09 CDS

SEQ ID NO: 548 - DNA, 627 bp, Artificial sequence
  SuR L6-4D10 CDS
atgggatctagattagataaaagtaaagtgattaacagcgcattagagctgcttaatgaggtcggaatcgaaggtttaacaacccgtaaactcgcccagaagctaggtgtagagcagcctacattgtattggcatgtaaaaaataagcgagctctgctcgacgccttagccattgagatgatggataggcaccaaactcactattgccctttagaaggggaaagctggcaagattttttacgtaataatgctaaaagtatgagatgtgctttactaagccatcgcgatggagcaaaagtatgtttaggtacacgctggacagaaaaacaatatgaaagtgctgaaaatatgttagcctttttatgccaacaaggtttttcactagagaatgcattatatgcagtgagtgctgtgagggtgtttactttaggttgcgtattgtttgatcaagagagccaagtcgctaaagaagaaagggaaacacctactactgctagtatgccgccattattgcgacaagcttgggaattaaaggatcaccaaggtgcagagccagccttcttattcggccttgaattgatcatatgcggattagaaaaacaacttaaatgcgaaagtgggtcttaa

SEQ ID NO: 549 - DNA, 627 bp, Artificial sequence
  SuR L6-4E01 CDS
atgggatctagattagataaaagtaaagtgattaacagcgcattagagctgcttaatgaggtcggaatcgaaggtttaacaacccgtaaactcgcccagaagctaggtgtagagcagcctacattgtattggcatgtaaaaaataagcgagctctgctcgacgccttagccattgagatgatggataggcaccaaactcacttgtgccctttagaaggggaaagctggcaagattttttacgtaataatgctaaaagtatgagatgtgctttactaagccatcgcgatggagcaaaagtatgtttaggtacacgctggacagaacaattgtatgaaagtgctgaaaatcaattagcctttttatgccaacaaggtttttcactagagaatgcattatatgcagtgagtgctgtgagggtgtttactttaggttgcgtattgtttgatcaagagagccaagtcgctaaagaagaaagggaaacacctactactgctagtatgccgccattattgcgacaagcttgggaattaaaggatcaccaaggtgcagagccagccttcttattcggccttgaattgatcatatgcggattagaaaaacaacttaaatgcgaaagtgggtcttaa

SEQ ID NO: 550 - DNA, 627 bp, Artificial sequence
  SuR L6-4E02 CDS
atgggatctagattagataaaagtaaagtgattaacagcgcattagagctgcttaatgaggtcggaatcgaaggtttaacaacccgtaaactcgcccagaagctaggtgtagagcagcctacattgtattggcatgtaaaaaataagcgagctctgctcgacgccttagccattgagatgatggataggcacgcaactcacttgtgccctttagaaggggaaagctggcaagattttttacgtaataatgctaaaagtatgagatgtgctttactaagccatcgcgatggagcaaaagtatgtttaggtacacgctggacagaaaaacaatatgaaactgctgaaaatatgttagcctttttatgccaacaaggtttttcactagagaatgcattatatgcagtgagtgctgtgagggtgtttactttaggttgcgtattgtttgatcaagagagccaagtcgctaaagaagaaagggaaacacctactactgctagtatgccgccattattgcgacaagtttgggaattaaaggatcaccaaggtgcagagccagccttcttattcggccttgaattgatcatatgcggattagaaaaacaacttaaatgcgaaagtgggtcttaa

SEQ ID NO: 551 - DNA, 627 bp, Artificial sequence
  SuR L6-4E03 CDS
atgggatctagattagataaaagtaaagtgattaacagcgcattagagctgcttaatgaggtcggaatcgaaggtttaacaacccgtaaactcgcccagaagctaggtgtagagcagcctacattgtattggcatgtaaaaaataagcgagctctgctcgacgccttagccattgagatgatggataggcacgcaactcacttttgccctttagaaggggaaagctggcaagattttttacgtaataatgctaaaagtatgagatgtgctttactaagccatcgcgatggagcaaaagtatgtgtaggtacacgctggacagaacaaatgtatgaagctgctgaaaatcaattagcctttttatgccaacaaggtttttcactagagaatgcattatatgcagtgagtgctgtgagggtgtttactttaggttgcgtattgtttgatcaagagctccaagtcgctaaagaagaaagggaaacacctactactrctagtatkccgccattagtgcgacaagcttgggaattaaaggatcaccaaggtgcagagccagccttcttattcggccttgaattgatcatatgcggattagaaaaacaacttaaatgcgaaagtgggtcttaa

SEQ ID NO: 552 - DNA, 627 bp, Artificial sequence
  SuR L6-4E05 CDS
atgggatctagattagataaaagtaaagtgattaacagcgcattagagctgcttaatgaggtcggaatcgaaggtttaacaacccgtaaactcgcccagaagctaggtgtagagcagcctacattgtattggcatgtaaaaaataagcgagctctgctcgacgccttagccattgagatgatggataggcaccaaactcacatttgccctttagaaggggaaagctggcaagattttttacgtaataatgctaaaagtatgagatgtgctttactaagccatcgcgatggagcaaaagtatgtgtaggtacacgctggacagaaaaacattatgaaagtgctgaaaatatgttagcctttttatgccaacaaggtttttcactagagaatgcattatatgcagtgagtgctgtgagggtgtttactttaggttgcgtattgtttgatcaagagagccaagtcgctaaagaagaaagggaaacacctactactgctagtatgccgccattattgcgacaagcttgggaattaaaggatcaccaaggtgcagagccagccttcttattcggccttgaattgatcatatgcggattagaaaaacaacttaaatgcgaaagtgggtcttaa

SEQ ID NO: 553 - DNA, 627 bp, Artificial sequence
  SuR L6-4E08 CDS
  misc_feature (303)..(303): n is a, c, g, or t
  misc_feature (349)..(349): n is a, c, g, or t
  misc_feature (418)..(418): n is a, c, g, or t
  misc_feature (454)..(454): n is a, c, g, or t
  misc_feature (524)..(524): n is a, c, g, or t
atgggatctagattagataaaagtaaagtgattaacagcgcattagagctgcttaatgaggtcggaatcgaaggtttaacaacccgtaaactcgcccagaagctaggtgtagagcagcctacattgtattggcatgtaaaaaataagcgagctctgctcgacgccttagccattgagatgatggataggcacgcaactcacttttgccctttagaaggggaaagctggcaagattttttacgtaataatgctaaaagtatgagatgtgctttactaagccatcgcgatggagcaaaagtatgnttaggtacacgctggacagaacaactgtatgaaactgctgaaaatntgttagcctttttatgccaacaaggtttttcactagagaatgcattatatgcaatgagtgctgtgaggnwctttactttaggttgcgtattgtttgatcaagagntccaagtcgctaaagaagaaagggaaacacctactactgctagtatgccgccattattgcgacaagtttnggaattaaaggatcaccaaggtgcagagccagccttcttattcggccttgaattgatcatatgcggattagaaaaacaacttaaatgcgaaagtgggtcttaa

SEQ ID NO: 554 - DNA, 627 bp, Artificial sequence
  SuR L6-4E09 CDS
atgggatctagattagataaaagtaaagtgattaacagcgcattagagctgcttaatgaggtcggaatcgaaggtttaacaacccgtaaactcgcccagaagctaggtgtagagcagcctacattgtattggcatgtaaaaaataagcgagctctgctcgacgccttagccattgagatgatggataggcacgcaactcacgtgtgccctttagaaggggaaagctggcaagattttttacgtaatactgctaaaagtatgagatgtgctttactaagccatcgcgatggagcaaaagtatgtttaggtacacgctggacagaacaacattatgaaactgctgaaaatatgttagcctttttatgccaacaaggtttttcactagagaatgcattatatgcaatgagtgctgtgagggtgtttactttaggttgcgtattgtttgatcaagagagccaagtcgctaaagaagaaagggaaacacctactactgctagtatgccgccattattgcgacaagtttgggaattaaaggatcaccaaggtgcagagccagccttcttattcggccttgaattgatcatatgcggattagaaaaacaacttaaatgcgaaagtgggtcttaa

SEQ ID NO: 555 - DNA, 627 bp, Artificial sequence
  SuR L6-4E11 CDS
  misc_feature (203)..(203): n is a, c, g, or t
  misc_feature (512)..(512): n is a, c, g, or t
atgggatctagattagataaaagtaaagtgattaacagcgcattagagctgcttaatgaggtcggaatcgaaggtttaacaacccgtaaactcgcccagaagctaggtgtagagcagcctacattgtattggcatgtaaaaaataagcgagctctgctcgacgccttagccattgagatgatggataggcacccaactcactnktgccctttagaaggggaaagctggcaagattttttacgtaatactgctaaaagtatgagatgtgctttactaagccatcgcgatggagcaaaagtatgtttaggtacacgctggacagaacaattgtatgaaactgctgaaaatatgttagcctttttatgccaacaaggtttttcactagagaatgcattatatgcaatgagtgctgtgaggaastttactttaggttgcgtattgtttgatcaagagatccaagtcgctaaagaagaaagggaaacacctactactgctagtatgcccccattagnccgacaagcttgggaattaaaggatcaccaaggtgcagagccagccttcttattcggccttgaattgatcatatgcggattagaaaaacaacttaaatgcgaaagtgggtcttaa

SEQ ID NO: 556 - DNA, 627 bp, Artificial sequence
  SuR L6-4E12 CDS
  misc_feature (454)..(454): n is a, c, g, or t
  misc_feature (511)..(511): n is a, c, g, or t
  misc_feature (521)..(521): n is a, c, g, or t
atgggatctagattagataaaagtaaagtgattaacagcgcattagagctgcttaatgaggtcggaatcgaaggtttaacaacccgtaaactcgcccagaagctaggtgtagagcagcctacattgtattggcatgtaaaaaataagcgagctctgctcgacgccttagccattgagatgatggataggcacgcaactcactattgccctttagaaggggaaagctggcaagattttttacgtaatactgctaaaagtatgagatgtgctttactaagccatcgcgatggagcaaaagtatgtttaggtacacgctggacagaaaaactgtatgaaactgctgaaaatatgttagcctttttatgccaacaaggtttttcactagagaatgcattatatgcasysagtgctgtgagggtgtttactttaggttgcgtattgtttgatcaagagntccaagtcgctaaagaagaaagggaaacacctactactgctagtatgccgccattancccgacaagnttgggaattaaaggatcaccaaggtgcagagccagccttcttattcggccttgaattgatcatatgcggattagaaaaacaacttaaatgcgaaagtgggtcttaa

SEQ ID NO: 557 - DNA, 627 bp, Artificial sequence
  SuR L6-4F01 CDS
atgggatctagattagataaaagtaaagtgattaacagcgcattagagctgcttaatgaggtcggaatcgaaggtttaacaacccgtaaactcgcccagaagctaggtgtagagcagcctacattgtattggcatgtaaaaaataagcgagctctgctcgacgccttagccattgagatgatggataggcacgcaactcacttgtgccctttagaaggggaaagctggcaagattttttacgtaatactgctaaaagtatgagatgtgctttactaagccatcgcgatggagcaaaagtatgtttaggtacacgctggacagaacaattgtatgaaactgctgaaaatatgttagcctttttatgccaacaaggtttttcactagagaatgcattatatgcagtgagtgctgtgagggtgtttactttaggttgcgtattgtttgatcaagasctccaagtcgctaaagaagaaagggaaacacctactwctgctagtatgycgccattagtgcgacaaggttgggaattaaaggatcaccaaggtgcagagccagccttcttattcggccttgaattgatcatatgcggattagaaaaacaacttaaatgcgaaagtgggtcttaa

SEQ ID NO: 558 - DNA, 627 bp, Artificial sequence
  SuR L6-4F10 CDS
  misc_feature (454)..(454): n is a, c, g, or t
atgggatctagattagataaaagtaaagtgattaacagcgcattagagctgcttaatgaggtcggaatcgaaggtttaacaacccgtaaactcgcccagaagctaggtgtagagcagcctacattgtattggcatgtaaaaaataagcgagctctgctcgacgccttagccattgagatgatggataggcaccaaactcactattgccctttagaaggggaaagctggcaagattttttacgtaataatgctaaaagtatgagatgtgctttactaagccatcgcgatggagcaaaagtatggttaggtacacgctggacagaacaactgtatgaagctgctgaaaatctgttagcctttttatgccaacaaggtttttcactagagaatgcattatatgcagtgagtgctgtgaggawctttactttaggttgcgtattgtttgatcaagagntccaagtcgctaaagaagaaagggaaacacctactactgctagtatgccgccattattgcgacaagcttgggaattaaaggatcaccaaggtgcagagccagccttcttattcggccttgaattgatcatatgcggattagaaaaacaacttaaatgcgaaagtgggtcttaa

SEQ ID NO: 559 - DNA, 627 bp, Artificial sequence
  SuR L6-4F12 CDS
atgggatctagattagataaaagtaaagtgattaacagcgcattagagctgcttaatgaggtcggaatcgaaggtttaacaacccgtaaactcgcccagaagctaggtgtagagcagcctacattgtattggcatgtaaaaaataagcgagctctgctcgacgccttagccattgagatgatggataggcaccaaactcactattgccctttagaaggggaaagctggcaagattttttacgtaataatgctaaaagtatgagatgtgctttactaagcaatcgcgatggagcaaaagtatgtttaggtacacgctggacagaaaaattgtatgaagctgctgaaaatcaattagcctttttatgccaacaaggtttttcactagagaatgcattatatgcagtgagtgctgtgagggtgtttactttaggttgcgtattgtttgatcaagagctccaagtcgctaaagaagaaagggaaacacctactactgctagtatkccgccattagtgcgacaagcttgggaattaaaggatcaccaaggtgcagagccagccttcttattcggccttgaattgatcatatgcggattagaaaaacaacttaaatgcgaaagtgggtcttaa

SEQ ID NO: 560 - DNA, 627 bp, Artificial sequence
  SuR L6-4G02 CDS
atgggatctagattagataaaagtaaagtgattaacagcgcattagagctgcttaatgaggtcggaatcgaaggtttaacaacccgtaaactcgcccagaagctaggtgtagagcagcctacattgtattggcatgtaaaaaataagcgagctctgctcgacgccttagccattgagatgatggataggcacgcaactcactattgccctttagaaggggaaagctggcaagattttttacgtaatactgctaaaagtatgagatgtgctttactaagccatcgcgatggagcaaaagtatgtttaggtacacgctggacagaacaattgtatgaaactgctgaaaatcaattagcctttttatgccaacaaggtttttcactagagaatgcattatatgcagtgagtgctgtgagggtgtttactttaggttgcgtattgtttgatcaagagctccaagtcgctaaagaagaaagggaaacacctactactgctagtatgccgccattattgcgacaagcttgggaattaaaggatcaccaaggtgcagagccagccttcttattcggccttgaattgatcatatgcggattagaaaaacaacttaaatgcgaaagtgggtcttaa

SEQ ID NO: 561 - DNA, 627 bp, Artificial sequence
  SuR L6-4G03 CDS
atgggatctagattagataaaagtaaagtgattaacagcgcattagagctgcttaatgaggtcggaatcgaaggtttaacaacccgtaaactcgcccagaagctaggtgtagagcagcctacattgtattggcatgtaaaaaataagcgagctctgctcgacgccttagccattgagatgatggataggcaccaaactcactattgccctttagaaggggaaagctggcaagattttttacgtaataatgctaaaagtatgagatgtgctttactaagccatcgcgatggagcaaaagtatgtttaggtacacgctggacagaaaaacattatgaaggtgctgaaaatcaattagcctttttatgccaacaaggtttttcactagagaatgcattatatgcaatgagtgctgtgagggtgtttactttaggttgcgtattgtttgatcaagagagccaagtcgctaaagaagaaagggaaacacctactactgctagtatgccgccattagtgcgacaagtttgggaattaaaggatcaccaaggtgcagagccagccttcttattcggccttgaattgatcatatgcggattagaaaaacaacttaaatgcgaaagtgggtcttaa

SEQ ID NO: 562 - DNA, 627 bp, Artificial sequence
  SuR L6-4G06 CDS
atgggatctagattagataaaagtaaagtgattaacagcgcattagagctgcttaatgaggtcggaatcgaaggtttaacaacccgtaaactcgcccagaagctaggtgtagagcagcctacattgtattggcatgtaaaaaataagcgagctctgctcgacgccttagccattgagatgatggataggcaccaaactcacatgtgccctttagaaggggaaagctggcaagattttttacgtaataatgctaaaagtatgagatgtgctttactaagccatcgcgatggagcaaaagtatgtttaggtacacgctggacagaaaaacattatgaaactgctgaaaatcaattagcctttttatgccaacaaggtttttcactagagaatgcattatatgcagtgagtgctgtgagggtgtttactttaggttgcgtattgtttgatcaagagctccaagtcgctaaagaagaaagggaaacacctactactgctagtatgccgccattagtgcgacaagcttgggaattaaaggatcaccaaggtgcagagccagccttcttattcggccttgaattgatcatatgcggattagaaaaacaacttaaatgcgaaagtgggtcttaa

SEQ ID NO: 563 - DNA, 627 bp, Artificial sequence
  SuR L6-4G07 CDS
atgggatctagattagataaaagtaaagtgattaacagcgcattagagctgcttaatgaggtcggaatcgaaggtttaacaacccgtaaactcgcccagaagctaggtgtagagcagcctacattgtattggcatgtaaaaaataagcgagctctgctcgacgccttagccattgagatgatggataggcacgcaactcacttgtgccctttagaaggggaaagctggcaagattttttacgtaataatgctaaaagtatgagatgtgctttactaagccatcgcgatggagcaaaagtatgtttaggtacacgctggacagaacaacaatatgaaactgctgaaaatatgttagcctttttatgccaacaaggtttttcactagagaatgcattatatgcagtgagtgctgtgaggaactttactttaggttgcgtattgtttgatcaagagagccaagtcgctaaagaagaaagggaaacacctactactgctagtatgccgccattattgcgacaagcttgggaattaaaggatcaccaaggtgcagagccagccttcttattgggccttgaattgatcatatgcggattagaaaaacaacttaaatgcgaaagtgggtcttaa

SEQ ID NO: 564 - DNA, 627 bp, Artificial sequence
  SuR L6-4G08 CDS
atgggatctagattagataaaagtaaagtgattaacagcgcattagagctgcttaatgaggtcggaatcgaaggtttaacaacccgtaaactcgcccagaagctaggtgtagagcagcctacattgtattggcatgtaaaaaataagcgagctctgctcgacgccttagccattgagatgatggataggcacccaactcactattgccctttagaaggggaaagctggcaagattttttacgtaataatgctaaaagtatgagatgtgctttactaagccatcgcgatggagcaaaagtatgtttaggtacacgctggacagaacaacaatatgaaactgctgaaaatcaattagcctttttatgccaacaaggtttttcactagagaatgcattatatgcaatgagtgctgtgaggaactttactttaggttgcgtattgtttgatcaagagakccaagtcgctaaagaagaaagggaaacacctactactgctagtatgccgccattattgcgacaagcttgggaattaaaggatcaccaaggtgcagagccagccttcttattcggccttgaattgatcatatgcggattagaaaaacaacttaaatgcgaaagtgggtcttaa

SEQ ID NO: 565 - DNA, 627 bp, Artificial sequence
  SuR L6-4G10 CDS
atgggatctagattagataaaagtaaagtgattaacagcgcattagagctgcttaatgaggtcggaatcgaaggtttaacaacccgtaaactcgcccagaagctaggtgtagagcagcctacattgtattggcatgtaaaaaataagcgagctctgctcgacgccttagccattgagatgatggataggcaccaaactcacttttgccctttagaaggggaaagctggcaagattttttacgtaatactgctaaaagtatgagatgtgctttactaagccatcgcgatggagcaaaagtatgtttaggtacacgctggacagaacaacaatatgaaactgctgaaaatatgttagcctttttatgccaacaaggtttttcactagagaatgcattatatgcagtgagtgctgtgagggtgtttactttaggttgcgtattgtttgatcaagagagccaagtcgctaaagaagaaagggaaacacctactactgctagtatgccgccattagcccgacaagcttgggaattaaaggatcaccaaggtgcagagccagccttcttattcggccttgaattgatcatatgcggattagaaaaacaacttaaatgcgaaagtgggtcttaa

SEQ ID NO: 566 - DNA, 627 bp, Artificial sequence
  SuR L6-4H07 CDS
atgggatctagattagataaaagtaaagtgattaacagcgcattagagctgcttaatgaggtcggaatcgaaggtttaacaacccgtaaactcgcccagaagctaggtgtagagcagcctacattgtattggcatgtaaaaaataagcgagctctgctcgacgccttagccattgagatgatggataggcaccaaactcacgtgtgccctttagaaggggaaagctggcaagattttttacgtaataatgctaaaagtatgagatgtgctttactaagccatcgcgatggagcaaaagtatgtttaggtacacgctggacagaacaaatgtatgaaactgctgaaaatcaattagcctttttatgccaacaaggtttttcactagagaatgcattatatgcagtgagtgctgtgagggtgtttactttaggttgcgtattgtttgatcaagagagccaagtcgctaaagaagaaagggaaacacctactactgctagtatgccgccattattgcgacaagcttgggaattaaaggatcaccaaggtgcagagccagccttcttattcggccttgaattgatcatatgcggattagaaaaacaacttaaatgcgaaagtgggtcttaa

SEQ ID NO: 567 - DNA, 627 bp, Artificial sequence
  SuR L6-5A02 CDS
atgggatctagattagataaaagtaaagtgattaacagcgcattagagctgcttaatgaggtcggaatcgaaggtttaacaacccgtaaactcgcccagaagctaggtgtagagcagcctacattgtattggcatgtaaaaaataagcgagctctgctcgacgccttagccattgagatgatggataggcacgcaactcactattgccctttagaaggggaaagctggcaagattttttacgtaatactgctaaaagtatgagatgtgctttactaagccatcgcgatggagcaaaagtatgtttaggtacacgctggacagaacaattgtatgaaactgctgaaaatcaattagcctttttatgccaacaaggtttttcactagagaatgcattatatgcaatgagtgctgtgagggtgtttactttaggttgcgtattgtttgatcaagagagccaagtcgctaaagaagaaagggaaacacctactactgctagtatgccgccattattgcgacaagcttgggaattaaaggatcaccaaggtgcagagccagccttcttattcggccttgaattgatcatatgcggattagaaaaacaacttaaatgcgaaagtgggtcttaa

SEQ ID NO: 568 - DNA, 627 bp, Artificial sequence
  SuR L6-5A03 CDS
atgggatctagattagataaaagtaaagtgattaacagcgcattagagctgcttaatgaggtcggaatcgaaggtttaacaacccgtaaactcgcccagaagctaggtgtagagcagcctacattgtattggcatgtaaaaaataagcgagctctgctcgacgccttagccattgagatgatggataggcacgcaactcactattgccctttagaaggggaaagctggcaagattttttacgtaataatgctaaaagtatgagatgtgctttactaagccatcgcgatggagcaaaagtatgtttaggtacacgctggacagaacaattgtatgaaactgctgaaaatatgttagcctttttatgccaacaaggtttttcactagagaatgcattatatgcaatgagtgctgtgagggtgtttactttaggttgcgtattgtttgatcaagagagccaagtcgctaaagaagaaagggaaacacctactactgctagtatgccgccattagtgcgacaaggttgggaattaaaggatcaccaaggtgcagagccagccttcttattcggccttgaattgatcatatgcggattagaaaaacaacttaaatgcgaaagtgggtcttaa

SEQ ID NO: 569 - DNA, 627 bp, Artificial sequence
  SuR L6-5A04 CDS
atgggatctagattagataaaagtaaagtgattaacagcgcattagagctgcttaatgaggtcggaatcgaaggtttaacaacccgtaaactcgcccagaagctaggtgtagagcagcctacattgtattggcatgtaaaaaataagcgagctctgctcgacgccttagccattgagatgatggataggcaccaaactcactattgccctttagaaggggaaagctggcaagattttttacgtaataatgctaaaagtatgagatgtgctttactaagccatcgcgatggagcaaaagtatggttaggtacacgctggacagaaaaacaatatgaaagtgctgaaaatatgttagcctttttatgccaacaaggtttttcactagagaatgcattatatgcagtgagtgctgtgagggtgtttactttaggttgcgtattgtttgatcaagagctccaagtcgctaaagaagaaagggaaacacctactactgctagtatgccgccattagtgcgacaagcttgggaattaaaggatcaccaaggtgcagagccagccttcttattcggccttgaattgatcatatgcggattagaaaaacaacttaaatgcgaaagtgggtcttaa

SEQ ID NO: 570 - DNA, 627 bp, Artificial sequence
  SuR L6-5A05 CDS
atgggatctagattagataaaagtaaagtgattaacagcgcattagagctgcttaatgaggtcggaatcgaaggtttaacaacccgtaaactcgcccagaagctaggtgtagagcagcctacattgtattggcatgtaaaaaataagcgagctctgctcgacgccttagccattgagatgatggataggcaccaaactcacatgtgccctttagaaggggaaagctggcaagattttttacgtaatactgctaaaagtatgagatgtgctttactaagccatcgcgatggagcaaaagtatgtttaggtacacgctggacagaacaaatgtatgaagctgctgaaaatcaattagcctttttatgccaacaaggtttttcactagagaatgcattatatgcaatgagtgctgtgagggtgtttactttaggttgcgtattgtttgatcaagagagccaagtcgctaaagaagaaagggaaacacctactactgctagtatgccgccattagtgcgacaagtttgggaattaaaggatcaccaaggtgcagagccagccttcttattcggccttgaattgatcatatgcggattagaaaaacaacttaaatgcgaaagtgggtcttaa

SEQ ID NO: 571 - DNA, 627 bp, Artificial sequence
  SuR L6-5A06 CDS
atgggatctagattagataaaagtaaagtgattaacagcgcattagagctgcttaatgaggtcggaatcgaaggtttaacaacccgtaaactcgcccagaagctaggtgtagagcagcctacattgtattggcatgtaaaaaataagcgagctctgctcgacgccttagccattgagatgatggataggcaccaaactcactattgccctttagaaggggaaagctggcaagattttttacgtaatactgctaaaagtatgagatgtgctttactaagccatcgcgatggagcaaaagtatgtttaggtacacgctggacagaacaaatgtatgaaactgctgaaaatcaattagcctttttatgccaacaaggtttttcactagagaatgcattatatgcaatgagtgctgtgagggtgtttactttaggttgcgtattgtttgatcaagagagccaagtcgctaaagaagaaagggaaacacctactactgctagtatgccgccattattgcgacaagtttgggaattaaaggatcaccaaggtgcagagccagccttcttattcggccttgaattgatcatatgcggattagaaaaacaacttaaatgcgaaagtgggtcttaa

SEQ ID NO: 572 - DNA, 627 bp, Artificial sequence
  SuR L6-5A07 CDS
  misc_feature (325)..(325): n is a, c, g, or t
  misc_feature (338)..(338): n is a, c, g, or t
  misc_feature (513)..(513): n is a, c, g, or t
atgggatctagattagataaaagtaaagtgattaacagcgcattagagctgcttaatgaggtcggaatcgaaggtttaacaacccgtaaactcgcccagaagctaggtgtagagcagcctacattgtattggcatgtaaaaaataagcgagctctgctcgacgccttagccattgagatgatggataggcaccaaactcacatttgccctttagaaggggaaagctggcaagattttttacgtaatactgctaaaagtatgagatgtgctttactaagccatcgcgatggagcaaaagtatgtttaggtacacgctggacagaanaacartatgaaantgctgaaaatatgttagcctttttatgccaacaaggtttttcactagagaatgcattatatgcaatgagtgctgtgagggtgtttactttaggttgcgtattgtttgatcaagagctccaagtcgctaaagaagaaagggaaacacctactactgctagtatgccgccattagtncgacaagtttgggaattaaaggatcaccaaggtgcagagccagccttcttattcggccttgaattgatcatatgcggattagaaaaacaacttaaatgcgaaagtgggtcttaa

SEQ ID NO: 573 - DNA, 627 bp, Artificial sequence
  SuR L6-5A09 CDS
atgggatctagattagataaaagtaaagtgattaacagcgcattagagctgcttaatgaggtcggaatcgaaggtttaacaacccgtaaactcgcccagaagctaggtgtagagcagcctacattgtattggcatgtaaaaaataagcgagctctgctcgacgccttagccattgagatgatggataggcaccaaactcacatgtgccctttagaaggggaaagctggcaagattttttacgtaataatgctaaaagtatgagatgtgctttactaagccatcgcgatggagcaaaagtatgtttaggtacacgctggacagaacaacattatgaagctgctgaaaatcaattagcctttttatgccaacaaggtttttcactagagaatgcattatatgcaatgagtgctgtgagggtgtttactttaggttgcgtattgtttgatcaagagagccaagtcgctaaagaagaaagggaaacacctactactgctagtatgccgccattagtgcgacaagcttgggaattaaaggatcaccaaggtgcagagccagccttcttattcggccttgaattgatcatatgcggattagaaaaacaacttaaatgcgaaagtgggtcttaa

SEQ ID NO: 574 - DNA, 627 bp, Artificial sequence
  SuR L6-5A10 CDS
  misc_feature (403)..(403): n is a, c, g, or t
  misc_feature (420)..(420): n is a, c, g, or t
  misc_feature (513)..(513): n is a, c, g, or t
atgggatctagattagataaaagtaaagtgattaacagcgcattagagctgcttaatgaggtcggaatcgaaggtttaacaacccgtaaactcgcccagaagctaggtgtagagcagcctacattgtattggcatgtaaaaaataagcgagctctgctcgacgccttagccattgagatgatggataggcacgcaactcactattgccctttagaaggggaaagctggcaagattttttacgtaatactgctaaaagtatgagatgtgctttactaagccatcgcgatggagcaaaagtatgtttaggtacacgctggacagaacaacattatgaaactgctgaaaatcaattagcctttttatgccaacaaggtttttcactagagaatgcattatatgcantgagtgctgtgagggtntttactttaggttgcgtattgtttgatcaagagctccaagtcgctaaagaagaaagggaaacacctactactgctagtatgccgccattattncgacaagtttgggaattaaaggatcaccaaggtgcagagccagccttcttattcggccttgaattgatcatatgcggattagaaaaacaacttaaatgcgaaagtgggtcttaa

SEQ ID NO: 575 - DNA, 627 bp, Artificial sequence
  SuR L6-5B02 CDS
  misc_feature (203)..(203): n is a, c, g, or t
  misc_feature (338)..(338): n is a, c, g, or t
  misc_feature (415)..(415): n is a, c, g, or t
atgggatctagattagataaaagtaaagtgattaacagcgcattagagctgcttaatgaggtcggaatcgaaggtttaacaacccgtaaactcgcccagaagctaggtgtagagcagcctacattgtattggcatgtaaaaaataagcgagctctgctcgacgccttagccattgagatgatggataggcaccaaactcactnttgccctttagaaggggaaagctggcaagattttttacgtaatactgctaaaagtatgagatgtgctttactaagccatcgcgatggagcaaaagtatgtttaggtacacgctggacagaacaactgtatgaagntgctgaaaatcaattagcctttttatgccaacaaggtttttcactagagaatgcattatatgcaatgagtgctgtgngggtgtttactttaggttgcgtattgtttgatcaagagctccaagtcgctaaagaagaaagggaaacacctactactgctagtatgccgccattatcccgacaagtttgggaattaaaggatcaccaaggtgcagagccagccttcttattcggccttgaattgatcatatgcggattagaaaaacaacttaaatgcgaaagtgggtcttaa

SEQ ID NO: 576 - DNA, 627 bp, Artificial sequence
  SuR L6-5B07 CDS
atgggatctagattagataaaagtaaagtgattaacagcgcattagagctgcttaatgaggtcggaatcgaaggtttaacaacccgtaaactcgcccagaagctaggtgtagagcagcctacattgtattggcatgtaaaaaataagcgagctctgctcgacgccttagccattgagatgatggataggcacgcaactcacatttgccctttagaaggggaaagctggcaagattttttacgtaataatgctaaaagtatgagatgtgctttactaagccatcgcgatggagcaaaagtatgtttaggtacacgctggacagaacaacaatatgaagctgctgaaaatatgttagcctttttatgccaacaaggtttttcactagagaatgcattatatgcaatgagtgctgtgagggtgtttactttaggttgcgtattgtttgatcaagagctccaagtcgctaaagaagaaagggaaacacctactactgctagtatgccgccattattgcgacaagtttgggaattaaaggatcaccaaggtgcagagccagccttcttattcggccttgaattgatcatatgcggattagaaaaacaacttaaatgcgaaagtgggtcttaa

SEQ ID NO: 577 - DNA, 627 bp, Artificial sequence
  SuR L6-5B08 CDS
atgggatctagattagataaaagtaaagtgattaacagcgcattagagctgcttaatgaggtcggaatcgaaggtttaacaacccgtaaactcgcccagaagctaggtgtagagcagcctacattgtattggcatgtaaaaaataagcgagctctgctcgacgccttagccattgagatgatggataggcaccaaactcacatttgccctttagaaggggaaagctggcaagattttttacgtaataatgctaaaagtatgagatgtgctttactaagccatcgcgatggagcaaaagtatgtttaggtacacgctggacagaacaacaatatgaaactgctgaaaatcaattagcctttttatgccaacaaggtttttcactagagaatgcattatatgcaatgagtgctgtgagggtgtttactttaggttgcgtattgtttgatcaagagagccaagtcgctaaagaagaaagggaaacacctactactgctagtatgccgccattagtgcgacaaggttgggaattaaaggatcaccaaggtgcagagccagccttcttattcggccttgaattgatcatatgcggattagaaaaacaacttaaatgcgaaagtgggtcttaa

SEQ ID NO: 578 - DNA, 627 bp, Artificial sequence
  SuR L6-5B11 CDS
atgggatctagattagataaaagtaaagtgattaacagcgcattagagctgcttaatgaggtcggaatcgaaggtttaacaacccgtaaactcgcccagaagctaggtgtagagcagcctacattgtattggcatgtaaaaaataagcgagctctgctcgacgccttagccattgagatgatggataggcaccaaactcacgtgtgccctttagaaggggaaagctggcaagattttttacgtaataatgctaaaagtatgagatgtgctttactaagccatcgcgatggagcaaaagtatgtttaggtacacgctggacagaacaacaatatgaaagtgctgaaaatatgttagcctttttatgccaacaaggtttttcactagagaatgcattatatgcaatgagtgctgtgagggtgtttactttaggttgcgtattgtttgatcaagagagccaagtcgctaaagaagaaagggaaacacctactactgctagtatgccgccattattgcgacaagttttggaattaaaggatcaccaaggtgcagagccagccttcttattcggccttgaattgatcatatgcggattagaaaaacaacttaaatgcgaaagtgggtcttaa

SEQ ID NO: 579 - DNA, 627 bp, Artificial sequence
  SuR L6-5C01 CDS
atgggatctagattagataaaagtaaagtgattaacagcgcattagagctgcttaatgaggtcggaatcgaaggtttaacaacccgtaaactcgcccagaagctaggtgtagagcagcctacattgtattggcatgtaaaaaataagcgagctctgctcgacgccttagccattgagatgatggataggcacgcaactaactattgccctttagaaggggaaagctggcaagattttttacgtaatactgctaaaagtatgagatgtgctttactaagccatcgcgatggagcaaaagtatgtttaggtacwcgctggacagaacaacaatatgaaactgctgaaaatatgttagcctttttatgccaacaaggtttttcactagagaatgcattatatgcagtgagtgctgtgagggtgtttactttaggttgcgtattgtttgatcaagagctccaagtcgctaaagaagaaagggaaacacctactactgctagtatgccgccattattgcgacaagtttgggaattaaaggatcaccaaggtgcagagccagccttcttattcggccttgaattgatcatatgcggattagaaaaacaacttaaatgcgaaagtgggtcttaa

SEQ ID NO: 580 - DNA, 627 bp, Artificial sequence
  SuR L6-5C02 CDS
atgggatctagattagataaaagtaaagtgattaacagcgcattagagctgcttaatgaggtcggaatcgaaggtttaacaacccgtaaactcgcccagaagctaggtgtagagcagcctacattgtattggcatgtaaaaaataagcgagctctgctcgacgccttagccattgagatgatggataggcaccaaactcacttttgccctttagaaggggaaagctggcaagattttttacgtaatactgctaaaagtatgagatgtgctttactaagccatcgcgatggagcaaaagtatggttaggtacacgctggacagaaaaacaatatgaaactgctgaaaatcaattagcctttttatgccaacaaggtttttcactagagaatgcattatatgcagtgagtgctgtgagggtgtttactttaggttgcgtattgtttgatcaagagctccaagtcgctaaagaagaaagggaaacacctactactgctagtatgccgccattattgcgacaagcttgggaattaaaggatcaccaaggtgcagagccagccttcttattcggccttgaattgatcatatgcggattagaaaaacaacttaaatgcgaaagtgggtcttaa

SEQ ID NO: 581 - DNA, 627 bp, Artificial sequence
  SuR L6-5C04 CDS
  misc_feature (325)..(325): n is a, c, g, or t
  misc_feature (328)..(330): n is a, c, g, or t
  misc_feature (337)..(337): n is a, c, g, or t
  misc_feature (415)..(415): n is a, c, g, or t
  misc_feature (418)..(420): n is a, c, g, or t
  misc_feature (513)..(513): n is a, c, g, or t
  misc_feature (521)..(521): n is a, c, g, or t
atgggatctagattagataaaagtaaagtgattaacagcgcattagagctgcttaatgaggtcggaatcgaaggtttaacaacccgtaaactcgcccagaagctaggtgtagagcagcctacattgtattggcatgtaaaaaataagcgagctctgctcgacgccttagccattgagatgatggataggcaccaaactcactattgccctttagaaggggaaagctggcaagattttttacgtaatactgctaaaagtatgagatgtgctttactaagccatcgcgatggagcaaaagtatgtttaggtacacgctggacagaanaannntatgaanctgctgaaaatcaattagcctttttatgccaacaaggtttttcactagagaatgcattatatgcaatgagtgctgtgnggnnntttactttaggttgcgtattgtttgatcaagagagccaagtcgctaaagaagaaagggaaacacctactactgctagtatgccgccattattncgacaagnttgggaattaaaggatcaccaaggtgcagagccagccttcttattcggccttgaattgatcatatgcggattagaaaaacaacttaaatgcgaaagtgggtcttaa

SEQ ID NO: 582 - DNA, 627 bp, Artificial sequence
  SuR L6-5C08 CDS
atgggatctagattagataaaagtaaagtgattaacagcgcattagagctgcttaatgaggtcggaatcgaaggtttaacaacccgtaaactcgcccagaagctaggtgtagagcagcctacattgtattggcatgtaaaaaataagcgagctctgctcgacgccttagccattgagatgatggataggcaccaaactcactattgccctttagaaggggaaagctggcaagattttttacgtaataatgctaaaagtatgagatgtgctttactaagccatcgcgatggagcaaaagtatgtttaggtacacgctggacagaacaattgtatgaaactgctgaaaatatgttagcctttttatgccaacaaggtttttcactagagaatgcattatatgcaatgagtgctgtgagggtgtttactttaggttgcgtattgtttgatcaagagagccaagtcgctaaagaagaaagggaaacacctactactgctagtatgccgccattattgcgacaagtttgggaattaaaggatcaccaaggtgcagagccagccttcttattcggccttgaattgatcatatgcggattagaaaaacaacttaaatgcgaaagtgggtcttaa

SEQ ID NO: 583 - DNA, 627 bp, Artificial sequence
  SuR L6-5C10 CDS
atgggatctagattagataaaagtaaagtgattaacagcgcattagagctgcttaatgaggtcggaatcgaaggtttaacaacccgtaaactcgcccagaagctaggtgtagagcagcctacattgtattggcatgtaaaaaataagcgagctctgctcgacgccttagccattgagatgatggataggcacgcaactcacttgtgccctttagaaggggaaagctggcaagattttttacgtaatactgctaaaagtatgagatgtgctttactaagccatcgcgatggagcaaaagtatgtttaggtacacgctggacagaacaacaatatgaagctgctgaaaatatgttagcctttttatgccaacaaggtttttcactagagaatgcattatatgcaatgagtgctgtgagggtgtttactttaggttgcgtattgtttgatcaagagagccaagtcgctaaagaagaaagggaaacacctactactgctagtatgccgccattattgcgacaagtttgggaattaaaggatcaccaaggtgcagagccagccttcttattcggccttgaattgatcatatgcggattagaaaaacaacttaaatgcgaaagtgggtcttaa

SEQ ID NO: 584 - DNA, 627 bp, Artificial sequence
  SuR L6-5C11 CDS
atgggatctagattagataaaagtaaagtgattaacagcgcattagagctgcttaatgaggtcggaatcgaaggtttaacaacccgtaaactcgcccagaagctaggtgtagagcagcctacattgtattggcatgtaaaaaataagcgagctctgctcgacgccttagccattgagatgatggataggcaccaaactcactattgccctttagaaggggaaagctggcaagattttttacgtaataatgctaaaagtatgagatgtgctttactaagccatcgcgatggagcaaaagtatgtttaggtacacgctggacagaaaaacattatgaaagtgctgaaaatatgttagcctttttatgccaacaaggtttttcactagagaatgcattatatgcaatgagtgctgtgagggtgtttactttaggttgcgtattgtttgatcaagagctccaagtcgctaaagaagaaagggaaacacctactactgctagtatgccgccattattgcgacaagtttgggaattaaaggatcaccaaggtgcagagccagccttcttattcggccttgaattgatcatatgcggattagaaaaacaacttaaatgcgaaagtgggtcttaa

SEQ ID NO: 585 - DNA, 627 bp, Artificial sequence
  SuR L6-5D04 CDS
atgggatctagattagataaaagtaaagtgattaacagcgcattagagctgcttaatgaggtcggaatcgaaggtttaacaacccgtaaactcgcccagaagctaggtgtagagcagcctacattgtattggcatgtaaaaaataagcgagctctgctcgacgccttagccattgagatgatggataggcaccaaactcactattgccctttagaaggggaaagctggcaagattttttacgtaataatgctaaaagtatgagatgtgctttactaagccatcgcgatggagcaaaagtatgtttaggtacacgctggacagaacaacattatgaaactgctgaaaatcaattagcctttttatgccaacaaggtttttcactagagaatgcattatatgcaatgagtgctgtgagggtgtttactttaggttgcgtattgtttgatcaagagagccaagtcgctaaagaagaaagggaaacacctactactgctagtatgccgccattagtgcgacaaggttgggaattaaaggatcaccaaggtgcagagccagccttcttattcggccttgaattgatcatatgcggattagaaaaacaacttaaatgcgaaagtgggtcttaa

SEQ ID NO: 586 - DNA, 627 bp, Artificial sequence
  SuR L6-5D09 CDS
atgggatctagattagataaaagtaaagtgattaacagcgcattagagctgcttaatgaggtcggaatcgaaggtttaacaacccgtaaactcgcccagaagctaggtgtagagcagcctacattgtattggcatgtaaaaaataagcgagctctgctcgacgccttagccattgagatgatggataggcacgcaactcactattgccctttagaaggggaaagctggcaagattttttacgtaataatgctaaaagtatgagatgtgctttactaagccatcgcgatggagcaaaagtatgtttaggtacacgctggacagaaaaacaatatgaagctgctgaaaatcaattagcctttttatgccaacaaggtttttcactagagaatgcattatatgcagtgagtgctgtgagggtgtttactttaggttgcgtattgtttgatcaagagagccaagtcgctaaagaagaaagggaaacacctactactgctagtatgccgccattattgcgacaaggttgggaattaaaggatcaccaaggtgcagagccagccttcttattcggccttgaattgatcatatgcggattagaaaaacaacttaaatgcgaaagtgggtcttaa

SEQ ID NO: 587 - DNA, 627 bp, Artificial sequence
  SuR L6-5D11 CDS
atgggatctagattagataaaagtaaagtgattaacagcgcattagagctgcttaatgaggtcggaatcgaaggtttaacaacccgtaaactcgcccagaagctaggtgtagagcagcctacattgtattggcatgtaaaaaataagcgagctctgctcgacgccttagccattgagatgatggataggcacgcaactcactattgccctttagaaggggaaagctggcaagattttttacgtaataatgctaaaagtatgagatgtgctttactaagccatcgcgatggagcaaaagtatgtttaggtacacgctggacagaacaattgtatgaagctgctgaaaatcaattagcctttttatgccaacaaggtttttcactagagaatgcattatatgcaatgagtgctgtgagggtgtttactttaggttgcgtattgtttgatcaagagagccaagtcgctaaagaagaaagggaaacacctactactgctagtatgccgccattagtgcgacaagtttgggaattaaaggatcaccaaggtgcagagccagccttcttattcggccttgaattgatcatatgcggattagaaaaacaacttaaatgcgaaagtgggtcttaa

SEQ ID NO: 588 - DNA, 627 bp, Artificial sequence; identical to SEQ ID NO: 448
  SuR L6-5D12 CDS

SEQ ID NO: 589 - DNA, 627 bp, Artificial sequence
  SuR L6-5E05 CDS
atgggatctagattagataaaagtaaagtgattaacagcgcattagagctgcttaatgaggtcggaatcgaaggtttaacaacccgtaaactcgcccagaagctaggtgtagagcagcctacattgtattggcatgtaaaaaataagcgagctctgctcgacgccttagccattgagatgatggataggcaccaaactcactattgccctttagaaggggaaagctggcaagattttttacgtaataatgctaaaagtatgagatgtgctttactaagccatcgcgatggagcaaaagtatgtttaggtacacgctggacagaaaaacattatgaaactgctgaaaatatgttagcctttttatgccaacaaggtttttcactagagaatgcattatatgcagtgagtgctgtgagggtgtttactttaggttgcgtattgtttgatcaagagctccaagtcgctaaagaagaaagggaaacacctactactgctagtatgccgccattattgcgacaagtttgggaattaaaggatcaccaaggtgcagagccagccttcttattcggccttgaattgatcatatgcggattagaaaaacaacttaaatgcgaaagtgggtcttaa

SEQ ID NO: 590 - DNA, 627 bp, Artificial sequence
  SuR L6-5E09 CDS
  misc_feature (193)..(193): n is a, c, g, or t
  misc_feature (330)..(330): n is a, c, g, or t
  misc_feature (337)..(338): n is a, c, g, or t
  misc_feature (403)..(403): n is a, c, g, or t
  misc_feature (512)..(512): n is a, c, g, or t
atgggatctagattagataaaagtaaagtgattaacagcgcattagagctgcttaatgaggtcggaatcgaaggtttaacaacccgtaaactcgcccagaagctaggtgtagagcagcctacattgtattggcatgtaaaaaataagcgagctctgctcgacgccttagccattgagatgatggataggcacncaactcactattgccctttagaaggggaaagctggcaagattttttacgtaatactgctaaaagtatgagatgtgctttactaagccatcgcgatggagcaaaagtatggttaggtacacgctggacagaacaacantatgaanntgctgaaaatctgttagcctttttatgccaacaaggtttttcactagagaatgcattatatgcantgagtgctgtgaggaactttactttaggttgcgtattgtttgatcaagagagccaagtcgctaaagaagaaagggaaacacctactactgctagtatgccgccattatnccgacaaggttgggaattaaaggatcaccaaggtgcagagccagccttcttattcggccttgaattgatcatatgcggattagaaaaacaacttaaatgcgaaagtgggtcttaa

SEQ ID NO: 591 - DNA, 627 bp, Artificial sequence
  SuR L6-5F02 CDS
atgggatctagattagataaaagtaaagtgattaacagcgcattagagctgcttaatgaggtcggaatcgaaggtttaacaacccgtaaactcgcccagaagctaggtgtagagcagcctacattgtattggcatgtaaaaaataagcgagctctgctcgacgccttagccattgagatgatggataggcaccaaactcacatttgccctttagaaggggaaagctggcaagattttttacgtaatactgctaaaagtatgagatgtgctttactaagccatcgcgatggagcaaaagtatgtttaggtacacgctggacagaaaaacattatgaagctgctgaaaatatgttagcctttttatgccaacaaggtttttcactagagaatgcattatatgcagtgagtgctgtgagggtgtttactttaggttgcgtattgtttgatcaagagagccaagtcgctaaagaagaaagggaaacacctactactgctagtatgccgccattagtgcgacaagtttgggaattaaaggatcaccaaggtgcagagccagccttcttattcggccttgaattgatcatatgcggattagaaaaacaacttaaatgcgaaagtgggtcttaa

SEQ ID NO: 592 - DNA, 627 bp, Artificial sequence
  SuR L6-5F04 CDS
atgggatctagattagataaaagtaaagtgattaacagcgcattagagctgcttaatgaggtcggaatcgaaggtttaacaacccgtaaactcgcccagaagctaggtgtagagcagcctacattgtattggcatgtaaaaaataagcgagctctgctcgacgccttagccattgagatgatggataggcaccaaactcactattgccctttagaaggggaaagctggcaagattttttacgtaataatgctaaaagtatgagatgtgctttactaagccatcgcgatggagcaaaagtatgtttaggtacacgctggacagaacaattgtatgaaagtgctgaaaatcaattagcctttttatgccaacaaggtttttcactagagaatgcattatatgcaatgagtgctgtgagggtgtttactttaggttgcgtattgtttgatcaagagctccaagtcgctaaagaagaaagggaaacacctactactgctagtatgccgccattattgcgacaaggttgggaattaaaggatcaccaaggtgcagagccagccttcttattcggccttgaattgatcatatgcggattagaaaaacaacttaaatgcgaaagtgggtcttaa

SEQ ID NO: 593 - DNA, 627 bp, Artificial sequence
  SuR L6-5F05 CDS
atgggatctagattagataaaagtaaagtgattaacagcgcattagagctgcttaatgaggtcggaatcgaaggtttaacaacccgtaaactcgcccagaagctaggtgtagagcagcctacattgtattggcatgtaaaaaataagcgagctctgctcgacgccttagccattgagatgatggataggcacgcaactcacatttgccctttagaaggggaaagctggcaagattttttacgtaataatgctaaaagtatgagatgtgctttactaagccatcgcgatggagcaaaagtatgtttaggtacacgctggacagaacaacaatatgaagctgctgaaaatcaattagcctttttatgccaacaaggtttttcactagagaatgcattatatgcagtgagtgctgtgagggtgtttactttaggttgcgtattgtttgatcaagagctccaagtcgctaaagaagaaagggaaacacctactactgctagtatgccgccattattgcgacaagcttgggaattaaaggatcaccaaggtgcagagccagccttcttattcggccttgaattgatcatatgcggattagaaaaacaacttaaatgcgaaagtgggtcttaa

SEQ ID NO: 594 - DNA, 627 bp, Artificial sequence
  SuR L6-5F07 CDS
atgggatctagattagataaaagtaaagtgattaacagcgcattagagctgcttaatgaggtcggaatcgaaggtttaacaacccgtaaactcgcccagaagctaggtgtagagcagcctacattgtattggcatgtaaaaaataagcgagctctgctcgacgccttagccattgagatgatggataggcacgcaactcactattgccctttagaaggggaaagctggcaagattttttacgtaataatgctaaaagtatgagatgtgctttactaagccatcgcgatggagcaaaagtatgtttaggtacacgctggacagaaaaacaatatgaaactgctgaaaatcaattagcctttttatgccaacaaggtttttcactagagaatgcattatatgcagtgagtgctgtgagggtgtttactttaggttgcgtattgtttgatcaagagctccaagtcgctaaagaagaaagggaaacacctactactgctagtatgccgccattattgcgacaagtttgggaattaaaggatcaccaaggtgcagagccagccttcttattcggccttgaattgatcatatgcggattagaaaaacaacttaaatgcgaaagtgggtcttaa

SEQ ID NO: 595 - DNA, 627 bp, Artificial sequence
  SuR L6-5F08 CDS
atgggatctagattagataaaagtaaagtgattaacagcgcattagagctgcttaatgaggtcggaatcgaaggtttaacaacccgtaaactcgcccagaagctaggtgtagagcagcctacattgtattggcatgtaaaaaataagcgagctctgctcgacgccttagccattgagatgatggataggcacgcaactcactattgccctttagaaggggaaagctggcaagattttttacgtaataatgctaaaagtatgagatgtgctttactaagccatcgcgatggagcaaaagtatgtttaggtacacgctggacagaaaaacattatgaaactgctgaaaatcaattagcctttttatgccaacaaggtttttcactagagaatgcattatatgcaatgagtgctgtgagggtgtttactttaggttgcgtattgtttgatcaagagagccaagtcgctaaagaagaaagggaaacacctactactgctagtatgccgccattattgcgacaagtttgggaattaaaggatcaccaaggtgcagagccagccttcttattcggccttgaattgatcatatgcggattagaaaaacaacttaaatgcgaaagtgggtcttaa

SEQ ID NO: 596 - DNA, 627 bp, Artificial sequence
  SuR L6-5F10 CDS
  misc_feature (328)..(328): n is a, c, g, or t
atgggatctagattagataaaagtaaagtgattaacagcgcattagagctgcttaatgaggtcggaatcgaaggtttaacaacccgtaaactcgcccagaagctaggtgtagagcagcctacattgtattggcatgtaaaaaataagcgagctctgctcgacgccttagccattgagatgatggataggcaccaaactcactattgccctttagaaggggaaagctggcaagattttttacgtaataatgctaaaagtatgagatgtgctttactaagccatcgcgatggagcaaaagtatggttaggtacacgctggacagaacaantgtatgaagctgctgaaaatatgttagcctttttatgccaacaaggtttttcactagagaatgcattatatgcagtgagtgctgtgggggtgtttactttaggttgcgtattgtttgatcaagagctccaagtcgctaaagaagaaagggaaacacctactactgctagtatgccgccattagcccgacaagttttggaattaaaggatcaccaaggtgcagagccagccttcttattcggccttgaattgatcatatgcggattagaaaaacaacttaaatgcgaaagtgggtcttaa

SEQ ID NO: 597 - DNA, 627 bp, Artificial sequence
  SuR L6-5F12 CDS
atgggatctagattagataaaagtaaagtgattaacagcgcattagagctgcttaatgaggtcggaatcgaaggtttaacaacccgtaaactcgcccagaagctaggtgtagagcagcctacattgtattggcatgtaaaaaataagcgagctctgctcgacgccttagccattgagatgatggataggcacgcaactcactattgccctttagaaggggaaagctggcaagattttttacgtaataatgctaaaagtatgagatgtgctttactaagccatcgcgatggagcaaaagtatgtttaggtacacgctggacagaaaaattgtatgaagctgctgaaaatatgttagcctttttatgccaacaaggtttttcactagagaatgcattatatgcagtgagtgctgtgagggtgtttactttaggttgcgtattgtttgatcaagagagccaagtcgctaaagaagaaagggaaacacctactactgctagtatgccgccattattgcgacaagtttgggaattaaaggatcaccaaggtgcagagccagccttcttattcggccttgaattgatcatatgcggattagaaaaacaacttaaatgcgaaagtgggtcttaa

SEQ ID NO: 598 - DNA, 627 bp, Artificial sequence
  SuR  L6-5G03 CDS
atgggatctagattagataaaagtaaagtgattaacagcgcattagagctgcttaatgaggtcggaatcgaaggtttaacaacccgtaaactcgcccagaagctaggtgtagagcagcctacattgtattggcatgtaaaaaataagcgagctctgctcgacgccttagccattgagatgatggataggcacgcaactcacatgtgccctttagaaggggaaagctggcaagattttttacgtaataatgctaaaagtatgagatgtgctttactaagccatcgcgatggagcaaaagtatggttaggtacacgctggacagaacaacaatatgaaactgctgaaaatatgttagcctttttatgccaacaaggtttttcactagagaatgcattatatgcagtgagtgctgtgagggtgtttactttaggttgcgtattgtttgatcaagagctccaagtcgctaaagaagaaagggaaacacctactactgctagtatgccgccattattgcgacaagtttgggaattaaaggatcaccaaggtgcagagccagccttcttattcggccttgaattgatcatatgcggattagaaaaacaacttaaatgcgaaagtgggtcttaa

SEQ ID NO: 599 - DNA, 627 bp, Artificial sequence
  SuR L6-5G05 CDS
atgggatctagattagataaaagtaaagtgattaacagcgcattagagctgcttaatgaggtcggaatcgaaggtttaacaacccgtaaactcgcccagaagctaggtgtagagcagcctacattgtattggcatgtaaaaaataagcgagctctgctcgacgccttagccattgagatgatggataggcaccaaactcactattgccctttagaaggggaaagctggcaagattttttacgtaataatgctaaaagtatgagatgtgctttactaagccatcgcgatggagcaaaagtatgtttaggtacacgctggacagaaaaacaatatgaaactgctgaaaatcaattagcctttttatgccaacaaggtttttcactagagaatgcattatatgcaatgagtgctgtgaggaactttactttaggttgcgtattgtttgatcaagagagccaagtcgctaaagaagaaagggaaacacctactactgctagtatgccgccattattgcgacaagcttgggaattaaaggatcaccaaggtgcagagccagccttcttattcggccttgaattgatcatatgcggattagaaaaacaacttaaatgcgaaagtgggtcttaa

SEQ ID NO: 600 - DNA, 627 bp, Artificial sequence
  SuR L6-5G06 CDS
atgggatctagattagataaaagtaaagtgattaacagcgcattagagctgcttaatgaggtcggaatcgaaggtttaacaacccgtaaactcgcccagaagctaggtgtagagcagcctacattgtattggcatgtaaaaaataagcgagctctgctcgacgccttagccattgagatgatggataggcaccaaactcactattgccctttagaaggggaaagctggcaagattttttacgtaataatgctaaaagtatgagatgtgctttactaagccatcgcgatggagcaaaagtatgtttaggtacacgctggacagaacaacaatatgaaactgctgaaaatcaattagcctttttatgccaacaaggtttttcactagagaatgcattatatgcagtgagtgctgtgagggtgtttactttaggttgcgtattgtttgatcaagagctccaagtcgctaaagaagaaagggaaacacctactactgctagtatgccgccattattgcgacaaggttgggaattaaaggatcaccaaggtgcagagccagccttcttattcggccttgaattgatcatatgcggattagaaaaacaacttaaatgcgaaagtgggtcttaa

SEQ ID NO: 601 - DNA, 627 bp, Artificial sequence
  SuR L6-5G08 CDS
atgggatctagattagataaaagtaaagtgattaacagcgcattagagctgcttaatgaggtcggaatcgaaggtttaacaacccgtaaactcgcccagaagctaggtgtagagcagcctacattgtattggcatgtaaaaaataagcgagctctgctcgacgccttagccattgagatgatggataggcaccaaactcacatttgccctttagaaggggaaagctggcaagattttttacgtaataatgctaaaagtatgagatgtgctttactaagccatcgcgatggagcaaaagtatgtttaggtacacgctggacagaaaaattgtatgaaactgctgaaaatcaattagcctttttatgccaacaaggtttttcactagagaatgcattatatgcaatgagtgctgtgagggtgtttactttaggttgcgtattgtttgatcaagagctccaagtcgctaaagaagaaagggaaacacctactactgctagtatgccgccattagtccgacaagtttgggaattaaaggatcaccaaggtgcagagccagccttcttattcggccttgaattgatcatatgcggattagaaaaacaacttaaatgcgaaagtgggtcttaa

SEQ ID NO: 602 - DNA, 627 bp, Artificial sequence
  SuR L6-5G11 CDS
atgggatctagattagataaaagtaaagtgattaacagcgcattagagctgcttaatgaggtcggaatcgaaggtttaacaacccgtaaactcgcccagaagctaggtgtagagcagcctacattgtattggcatgtaaaaaataagcgagctctgctcgacgccttagccattgagatgatggataggcaccaaactcacatttgccctttagaaggggaaagctggcaagattttttacgtaataatgctaaaagtatgagatgtgctttactaagccatcgcgatggagcaaaagtatgtttaggtacacgctggacagaaaaacaatatgaaagtgctgaaaatatgttagcctttttatgccaacaaggtttttcactagagaatgcattatatgcagtgagtgctgtgagggtgtttactttaggttgcgtattgtttgatcaagagctccaagtcgctaaagaagaaagggaaacacctactactgctagtatgccgccattagtgcgacaagtttgggaattaaaggatcaccaaggtgcagagccagccttcttattcggccttgaattgatcatatgcggattagaaaaacaacttaaatgcgaaagtgggtcttaa

SEQ ID NO: 603 - DNA, 627 bp, Artificial sequence
  SuR L6-5G12 CDS
atgggatctagattagataaaagtaaagtgattaacagcgcattagagctgcttaatgaggtcggaatcgaaggtttaacaacccgtaaactcgcccagaagctaggtgtagagcagcctacattgtattggcatgtaaaaaataagcgagctctgctcgacgccttagccattgagatgatggataggcacgcaactcacttgtgccctttagaaggggaaagctggcaagattttttacgtaataatgctaaaagtatgagatgtgctttactaagccatcgcgatggagcaaaagtatgtttaggtacacgctggacagaaaaacaatatgaagctgctgaaaatcaattagcctttttatgccaacaaggtttttcactagagaatgcattatatgcagtgagtgctgtgagggtgtttactttaggttgcgtattgtttgatcaagagagccaagtcgctaaagaagaaagggaaacacctactactgctagtatgccgccattattgcgacaagtttgggaattaaaggatcaccaaggtgcagagccagccttcttattcggccttgaattgatcatatgcggattagaaaaacaacttaaatgcgaaagtgggtcttaa

SEQ ID NO: 604 - DNA, 627 bp, Artificial sequence
  SuR L6-5H03 CDS
atgggatctagattagataaaagtaaagtgattaacagcgcattagagctgcttaatgaggtcggaatcgaaggtttaacaacccgtaaactcgcccagaagctaggtgtagagcagcctacattgtattggcatgtaaaaaataagcgagctctgctcgacgccttagccattgagatgatggataggcacgcaactcacttgtgccctttagaaggggaaagctggcaagattttttacgtaataatgctaaaagtatgagatgtgctttactaagccatcgcgatggagcaaaagtatgtttaggtacacgctggacagaacaattgtatgaaactgctgaaaatatgttagcctttttatgccaacaaggtttttcactagagaatgcattatatgcagtgagtgctgtgaggaactttactttaggttgcgtattgtttgatcaagagagccaagtcgctaaagaagaaagggaaacacctactactgctagtatgccgccattattgcgacaagtttgggaattaaaggatcaccaaggttcagagccagccttcttattcggccttgaattgatcatatgcggattagaaaaacaacttaaatgcgaaagtgggtcttaa

SEQ ID NO: 605 - DNA, 627 bp, Artificial sequence
  SuR L6-5H06 CDS
atgggatctagattagataaaagtaaagtgattaacagcgcattagagctgcttaatgaggtcggaatcgaaggtttaacaacccgtaaactcgcccagaagctaggtgtagagcagcctacattgtattggcatgtaaaaaataagcgagctctgctcgacgccttagccattgagatgatggataggcaccaaactcacatttgccctttagaaggggaaagctggcaagattttttacgtaataatgctaaaagtatgagatgtgctttactaagccatcgcgatggagcaaaagtatgtttaggtacacggtggacagaaaaacaatatgaaactgctgaaaatatgttagcctttttatgccaacaaggtttttcactagagaatgcattatatgcagtgagtgctgtgagggtgtttactttaggttgcgtattgtttgatcaagagctccaagtcgctaaagaagaaagggaaacacctactactgctagtatgccgccattagtgcgacaagcttgggaattaaaggatcaccaaggtgcagagccagccttcttattcggccttgaattgatcatatgcggattagaaaaacaacttaaatgcgaaagtgggtcttaa

SEQ ID NO: 606 - DNA, 627 bp, Artificial sequence
  SuR L6-5H07 CDS
atgggatctagattagataaaagtaaagtgattaacagcgcattagagctgcttaatgaggtcggaatcgaaggtttaacaacccgtaaactcgcccagaagctaggtgtagagcagcctacattgtattggcatgtaaaaaataagcgagctctgctcgacgccttagccattgagatgatggataggcaccaaactcacatgtgccctttagaaggggaaagctggcaagattttttacgtaataatgctaaaagtatgagatgtgctttactaagccatcgcgatggagcaaaagtatgtttaggtacacgctggacagaacaacaatatgaagctgctgaaaatatgttagcctttttatgccaacaaggtttttcactagagaatgcattatatgcaatgagtgctgtgaggaactttactttaggttgcgtattgtttgatcaagagagccaagtcgctaaagaagaaagggaaacacctactactgctagtatgccgccattattgcgacaagcttgggaattaaaggatcaccaaggtgcagagccagccttcttattcggccttgaattgatcatatgcggattagaaaaacaacttaaatgcgaaagtgggtcttaa

SEQ ID NO: 607 - DNA, 627 bp, Artificial sequence
  SuR L6-5H12 CDS
atgggatctagattagataaaagtaaagtgattaacagcgcattagagctgcttaatgaggtcggaatcgaaggtttaacaacccgtaaactcgcccagaagctaggtgtagagcagcctacattgtattggcatgtaaaaaataagcgagctctgctcgacgccttagccattgagatgatggataggcacgcaactcactattgccctttagaaggggaaagctggcaagattttttacgtaataatgctaaaagtatgagatgtgctttactaagccatcgcgatggagcaaaagtatgtttaggtacacgctggacagaaaaacaatatgaaactgctgaaaatcaattagcctttttatgccaacaaggtttttcactagagaatgcattatatgcaatgagtgctgtgagggtgtttactttaggttgcgtattgtttgatcaagagctccaagtcgctaaagaagaaagggaaacacctactactgctagtatgccgccattagtgcgacaagcttgggaattaaaggatcaccaaggtgcagagccagccttcttattcggccttgaattgatcatatgcggattagaaaaacaacttaaatgcgaaagtgggtcttaa

SEQ ID NO: 608 - DNA, 627 bp, Artificial sequence
  SuR L6-6A09 CDS
atgggatctagattagataaaagtaaagtgattaacagcgcattagagctgcttaatgaggtcggaatcgaaggtttaacaacccgtaaactcgcccagaagctaggtgtagagcagcctacattgtattggcatgtaaaaaataagcgagctctgctcgacgccttagccattgagatgatggataggcaccaaactcactattgccctttagaaggggaaagctggcaagattttttacgtaatactgctaaaagtatgagatgtgctttactaagccatcgcgatggagcaaaagtatgtttaggtacacgctggacagaaaaacaatatgaaactgctgaaaatatgttagcctttttatgccaacaaggtttttcactagagaatgcattatatgcagtgagtgctgtgagggtgtttactttaggttgcgtattgtttgatcaagagagccaagtcgctaaagaagaaagggaaacacctactactgctagtatgccgccattattgcgacaaggtttggaattaaaggatcaccaaggtgcagagccagccttcttattcggccttgaattgatcatatgcggattagaaaaacaacttaaatgcgaaagtgggtcttaa

SEQ ID NO: 609 - DNA, 627 bp, Artificial sequence
  SuR L6-6B01 CDS
  misc_feature (194)..(194): n is a, c, g, or t
atgggatctagattagataaaagtaaagtgattaacagcgcattagagctgcttaatgaggtcggaatcgaaggtttaacaacccgtaaactcgcccagaagctaggtgtagagcagcctacattgtattggcatgtaaaaaataagcgagctctgctcgacgccttagccattgagatgatggataggcaccnaactcactattgccctttagaaggggaaagctggcaagattttttacgtaataatgctaaaagtatgagatgtgctttactaagccatcgcgatggagcaaaagtatgtttaggtacacgctggacagaaaaacattatgaaactgctgaaaatatgttagcctttttatgccaacaaggtttttcactagagaatgcattatatgcaatgagtgctgtgaggaactttactttaggtggcgtattgtttgatcaagagagccaagtcgctaaagaagaaagggaaacacctactactgctagtatgccgccattagcccgacaagtttgggaattaaaggatcaccaaggtgcagagccagccttcttattcggccttgaattgatcatatgcggattagaaaaacaacttaaatgcgaaagtgggtcttaa

SEQ ID NO: 610 - DNA, 627 bp, Artificial sequence
  SuR L6-6B03 CDS
atgggatctagattagataaaagtaaagtgattaacagcgcattagagctgcttaatgaggtcggaatcgaaggtttaacaacccgtaaactcgcccagaagctaggtgtagagcagcctacattgtattggcatgtaaaaaataagcgagctctgctcgacgccttagccattgagatgatggataggcaccaaactcacatttgccctttagaaggggaaagctggcaagattttttacgtaataatgctaaaagtatgagatgtgctttactaagccatcgcgatggagcaaaagtatgtttaggtacacgctggacagaaaaaatgtatgaaactgctgaaaatcaattagcctttttatgccaacaaggtttttcactagagaatgcattatatgcaatgagtgctgtgagggtgtttactttaggttgcgtattgtttgatcaagagctccaagtcgctaaagaagaaagggaaacacctactactgctagtatgccgccattattgcgacaagcttgggaattaaaggatcaccaaggtgcagagccagccttcttattcggccttgaattgatcatatgcggattagaaaaacaacttaaatgcgaaagtgggtcttaa

SEQ ID NO: 611 - DNA, 627 bp, Artificial sequence
  SuR L6-6B04 CDS
atgggatctagattagataaaagtaaagtgattaacagcgcattagagctgcttaatgaggtcggaatcgaaggtttaacaacccgtaaactcgcccagaagctaggtgtagagcagcctacattgtattggcatgtaaaaaataagcgagctctgctcgacgccttagccattgagatgatggataggcaccaaactcactattgccctttagaaggggaaagctggcaagattttttacgtaatactgctaaaagtatgagatgtgctttactaagccatcgcgatggagcaaaagtatgtttaggtacacgctggacagaacaacaatatgaaactgctgaaaatatgttagcctttttatgccaacaaggtttttcactagagaatgcattatatgcagtgagtgctgtgagggtgtttactttaggttgcgtattgtttgatcaagagagccaagtcgctaaagaagaaagggaaacacctactactgctagtatgccgccattattgcgacaagcttgggaattaaaggatcaccaaggtgcagagccagccttcttattcggccttgaattgatcatatgcggattagaaaaacaacttaaatgcgaaagtgggtcttaa

SEQ ID NO: 612 - DNA, 627 bp, Artificial sequence
  SuR L6-6B05 CDS
atgggatctagattagataaaagtaaagtgattaacagcgcattagagctgcttaatgaggtcggaatcgaaggtttaacaacccgtaaactcgcccagaagctaggtgtagagcagcctacattgtattggcatgtaaaaaataagcgagctctgctcgacgccttagccattgagatgatggataggcacgcaactcactattgccctttagaaggggaaagctggcaagattttttacgtaataatgctaaaagtatgagatgtgctttactaagccatcgcgatggagcaaaagtatgtttaggtacacgctggacagaacaacattatgaaactgctgaaaatcaattagcctttttatgccaacaaggtttttcactagagaatgcattatatgcagtgagtgctgtgagggtgtttactttaggttgcgtattgtttgatcaagagagccaagtcgctaaagaagaaagggaaacacctactactgctagtatgccgccattattgcgacaagtttgggaattaaaggatcaccaaggtgcagagccagccttcttattcggccttgaattgatcatatgcggattagaaaaacaacttaaatgcgaaagtgggtcttaa

SEQ ID NO: 613 - DNA, 627 bp, Artificial sequence
  SuR L6-6B10 CDS
atgggatctagattagataaaagtaaagtgattaacagcgcattagagctgcttaatgaggtcggaatcgaaggtttaacaacccgtaaactcgcccagaagctaggtgtagagcagcctacattgtattggcatgtaaaaaataagcgagctctgctcgacgccttagccattgagatgatggataggcacgcaactcacttgtgccctttagaaggggaaagctggcaagattttttacgtaataatgctaaaagtatgagatgtgctttactaagccatcgcgatggagcaaaagtatgtttaggtacacgctggacagaaaaacaatatgaaactgctgaaaatcaattagcctttttatgccaacaaggtttttcactagagaatgcattatatgcagtgagtgctgtgagggtgtttactttaggttgcgtattgtttgatcaagagagccaagtcgctaaagaagaaagggaaacacctactactgctagtatgccgccattattgcgacaagtttgggaattaaaggatcaccaaggtgcagagccagccttcttattcggccttgaattgatcatatgcggattagaaaaacaacttaaatgcgaaagtgggtcttaa

SEQ ID NO: 614 - DNA, 627 bp, Artificial sequence
  SuR L6-6C01 CDS
atgggatctagattagataaaagtaaagtgattaacagcgcattagagctgcttaatgaggtcggaatcgaaggtttaacaacccgtaaactcgcccagaagctaggtgtagagcagcctacattgtattggcatgtaaaaaataagcgagctctgctcgacgccttagccattgagatgatggataggcaccaaactcactattgccctttagaaggggaaagctggcaagattttttacgtaataatgctaaaagtatgagatgtgctttactaagccatcgcgatggagcaaaagtatgtttaggtacacgctggacagaacaacaatatgaaactgctgaaaatatgttagcctttttatgccaacaaggtttttcactagagaatgcattatatgcaatgagtgctgtgagggtgtttactttaggttgcgtattgtttgatcaagagagccaagtcgctaaagaagaaagggaaacacctactactgctagtatgccgccattattgcgacaagctttggaattaaaggatcaccaaggtgcagagccagccttcttattcggccttgaattgatcatatgcggattagaaaaacaacttaaatgcgaaagtgggtcttaa

SEQ ID NO: 615 - DNA, 627 bp, Artificial sequence
  SuR L6-6C02 CDS
atgggatctagattagataaaagtaaagtgattaacagcgcattagagctgcttaatgaggtcggaatcgaaggtttaacaacccgtaaactcgcccagaagctaggtgtagagcagcctacattgtattggcatgtaaaaaataagcgagctctgctcgacgccttagccattgagatgatggataggcaccaaactcacttttgccctttagaaggggaaagctggcaagattttttacgtaatactgctaaaagtatgagatgtgctttactaagccatcgcgatggagcaaaagtatgtttaggtacacgctggacagaacaattgtatgaagctgctgaaaatatgttagcctttttatgccaacaaggtttttcactagagaatgcattatatgcagtgagtgctgtgagggtgtttactttaggttgcgtattgtttgatcaagagagccaagtcgctaaagaagaaagggaaacacctactactgctagtatgccgccattattgcgacaaggttgggaattaaaggatcaccaaggtgcagagccagccttcttattcggccttgaattgatcatatgcggattagaaaaacaacttaaatgcgaaagtgggtcttaa

SEQ ID NO: 616 - DNA, 627 bp, Artificial sequence
  SuR L6-6C04 CDS
atgggatctagattagataaaagtaaagtgattaacagcgcattagagctgcttaatgaggtcggaatcgaaggtttaacaacccgtaaactcgcccagaagctaggtgtagagcagcctacattgtattggcatgtaaaaaataagcgagctctgctcgacgccttagccattgagatgatggataggcacgcaactcacttgtgccctttagaaggggaaagctggcaagattttttacgtaataatgctaaaagtatgagatgtgctttactaagccatcgcgatggagcaaaagtatgtttaggtacacgctggacagaacaattgtatgaaactgctgaaaatcaattagcctttttatgccaacaaggtttttcactagagaatgcattatatgcagtgagtgctgtgagggtgtttactttaggttgcgtattgtttgatcaagagagccaagtcgctaaagaagaaagggaaacacctactactgctagtatgccgccattattgcgacaagtttgggaattaaaggatcaccaaggtgcagagccagccttcttattcggccttgaattgatcatatgcggattagaaaaacaacttaaatgcgaaagtgggtcttaa

SEQ ID NO: 617 - DNA, 627 bp, Artificial sequence
  SuR L6-6C05 CDS
atgggatctagattagataaaagtaaagtgattaacagcgcattagagctgcttaatgaggtcggaatcgaaggtttaacaacccgtaaactcgcccagaagctaggtgtagagcagcctacattgtattggcatgtaaaaaataagcgagctctgctcgacgccttagccattgagatgatggataggcaccaaactcactattgccctttagaaggggaaagctggcaagattttttacgtaataatgctaaaagtatgagatgtgctttactaagccatcgcgatggagcaaaagtatgtttaggtacacgctggacagaacaaatgtatgaaggtgctgaaaatatgttagcctttttatgccaacaaggtttttcactagagaatgcattatatgcagtgagtgctgtgaggaactttactttaggttgcgtattgtttgatcaagagagccaagtcgctaaagaagaaagggaaacacctactactgctagtatgccgccattattgcgacaagcttgggaattaaaggatcaccaaggtgcagagccagccttcttattcggccttgaattgatcatatgcggattagaaaaacaacttaaatgcgaaagtgggtcttaa

SEQ ID NO: 618 - DNA, 627 bp, Artificial sequence
  SuR L6-6C06 CDS
atgggatctagattagataaaagtaaagtgattaacagcgcattagagctgcttaatgaggtcggaatcgaaggtttaacaacccgtaaactcgcccagaagctaggtgtagagcagcctacattgtattggcatgtaaaaaataagcgagctctgctcgacgccttagccattgagatgatggataggcacgcaactcactattgccctttagaaggggaaagctggcaagattttttacgtaataatgctaaaagtatgagatgtgctttactaagccatcgcgatggagcaaaagtatgtttaggtacacgctggacagaacaacaatatgaaactgctgaaaatcaattagcctttttatgccaacaaggtttttcactagagaatgcattatatgcaatgagtgctgtgagggtgtttactttaggttgcgtattgtttgatcaagagagccaagtcgctaaagaagaaagggaaacacctactagtgctagtatgccgccattagtgcgacaagtttgggaattaaaggatcaccaaggtgcagagccagccttcttattcggccttgaattgatcatatgcggattagaaaaacaacttaaatgcgaaagtgggtcttaa

SEQ ID NO: 619 - DNA, 627 bp, Artificial sequence
  SuR L6-6C07 CDS
atgggatctagattagataaaagtaaagtgattaacagcgcattagagctgcttaatgaggtcggaatcgaaggtttaacaacccgtaaactcgcccagaagctaggtgtagagcagcctacattgtattggcatgtaaaaaataagcgagctctgctcgacgccttagccattgagatgatggataggcaccaaactcactattgccctttagaaggggaaagctggcaagattttttacgtaatactgctaaaagtatgagatgtgctttactaagccatcgcgatggagcaaaagtatgtttaggtacacgctggacagaaaaacaatatgaagctgctgaaaatatgttagcctttttatgccaacaaggtttttcactagagaatgcattatatgcaatgagtgctgtgagggtgtttactttaggttgcgtattgtttgatcaagagagccaagtcgctaaagaagaaagggaaacacctactactgctagtatgccgccattattgcgacaagcttgggaattaaaggatcaccaaggtgcagagccagccttcttattcggccttgaattgatcatatgcggattagaaaaacaacttaaatgcgaaagtgggtcttaa

SEQ ID NO: 620 - DNA, 627 bp, Artificial sequence
  SuR L6-6C10 CDS
atgggatctagattagataaaagtaaagtgattaacagcgcattagagctgcttaatgaggtcggaatcgaaggtttaacaacccgtaaactcgcccagaagctaggtgtagagcagcctacattgtattggcatgtaaaaaataagcgagctctgctcgacgccttagccattgagatgatggataggcaccaaactcacttgtgccctttagaaggggaaagctggcaagattttttacgtaataatgctaaaagtatgagatgtgctttactaagccatcgcgatggagcaaaagtatgtttaggtacacgctggacagaacaattgtatgaagctgctgaaaatatgttagcctttttatgccaacaaggtttttcactagagaatgcattatatgcagtgagtgctgtgagggtgtttactttaggttgcgtattgtttgatcaagagagccaagtcgctaaagaagaaagggaaacacctactactgctagtatgccgccattagtgcgacaaggttgggaattaaaggatcaccaaggtgcagagccagccttcttattcggccttgaattgatcatatgcggattagaaaaacaacttaaatgcgaaagtgggtcttaa

SEQ ID NO: 621 - DNA, 627 bp, Artificial sequence
  SuR L6-6C11 CDS
atgggatctagattagataaaagtaaagtgattaacagcgcattagagctgcttaatgaggtcggaatcgaaggtttaacaacccgtaaactcgcccagaagctaggtgtagagcagcctacattgtattggcatgtaaaaaataagcgagctctgctcgacgccttagccattgagatgatggataggcaccaaactcactattgccctttagaaggggaaagctggcaagattttttacgtaatactgctaaaagtatgagatgtgctttactaagccatcgcgatggagcaaaagtatgtttaggtacacgctggacagaacaattgtatgaaactgctgaaaatcaattagcctttttatgccaacaaggtttttcactagagaatgcattatatgcaatgagtgctgtgagggtgtttactttaggttgcgtattgtttgatcaagagagccaagtcgctaaagaagaaagggaaacacctactactgctagtatgccgccattattgcgacaaggttgggaattaaaggatcaccaaggtgcagagccagccttcttattcggccttgaattgatcatatgcggattagaaaaacaacttaaatgcgaaagtgggtcttaa

SEQ ID NO: 622 - DNA, 627 bp, Artificial sequence
  SuR L6-6D02 CDS
atgggatctagattagataaaagtaaagtgattaacagcgcattagagctgcttaatgaggtcggaatcgaaggtttaacaacccgtaaactcgcccagaagctaggtgtagagcagcctacattgtattggcatgtaaaaaataagcgagctctgctcgacgccttagccattgagatgatggataggcaccaaactcactattgccctttagaaggggaaagctggcaagattttttacgtaatactgctaaaagtatgagatgtgctttactaagccatcgcgatggagcaaaagtatgtttaggtacacgctggacagaacaacattatgaagctgctgaaaatatgttagcctttttatgccaacaaggtttttcactagagaatgcattatatgcaatgagtgctgtgagggtgtttactttaggttgcgtattgtttgatcaagagagccaagtcgctaaagaagaaagggaaacacctactactgctagtatgccgccattattgcgacaagcttgggaattaaaggatcaccaaggtgcagagccagccttcttattgggccttgaattgatcatatgcggattagaaaaacaacttaaatgcgaaagtgggtcttaa

SEQ ID NO: 623 - DNA, 627 bp, Artificial sequence
  SuR L6-6D06 CDS
atgggatctagattagataaaagtaaagtgattaacagcgcattagagctgcttaatgaggtcggaatcgaaggtttaacaacccgtaaactcgcccagaagctaggtgtagagcagcctacattgtattggcatgtaaaaaataagcgagctctgctcgacgccttagccattgagatgatggataggcaccaaactcacatgtgccctttagaaggggaaagctggcaagattttttacgtaataatgctaaaagtatgagatgtgctttactaagccatcgcgatggagcaaaagtatgtttaggtacacgctggacagaaaaacaatatgaaggtgctgaaaatcaattagcctttttatgccaacaaggtttttcactagagaatgcattatatgcagtgagtgctgtgagggtgtttactttaggttgcgtattgtttgatcaagagagccaagtcgctaaagaagaaagggaaacacctactactgctagtatgccgccattagtgcgacaagtttgggaattaaaggatcaccaaggtgcagagccagccttcttattcggccttgaattgatcatatgcggattagaaaaacaacttaaatgcgaaagtgggtcttaa

SEQ ID NO: 624 - DNA, 627 bp, Artificial sequence
  SuR L6-6D07 CDS
atgggatctagattagataaaagtaaagtgattaacagcgcattagagctgcttaatgaggtcggaatcgaaggtttaacaacccgtaaactcgcccagaagctaggtgtagagcagcctacattgtattggcatgtaaaaaataagcgagctctgctcgacgccttagccatagagatgatggataggcaccaaactcacatttgccctttagaaggggaaagctggcaagattttttacgtaataatgctaaaagtatgagatgtgctttactaagccatcgcgatggagcaaaagtatgtttaggtacacgctggacagaacaacaatatgaaggtgctgaaaatcaattagcctttttatgccaacaaggtttttcactagagaatgcattatatgcaatgagtgctgtgagggtgtttactttaggttgcgtattgtttgatcaagagagccaagtcgctaaagaagaaagggaaacacctactactgctagtatgccgccattattgcgacaaggttgggaattaaaggatcaccaaggtgcagagccagccttcttattcggccttgaattgatcatatgcggattagaaaaacaacttaaatgcgaaagtgggtcttaa

SEQ ID NO: 625 - DNA, 627 bp, Artificial sequence
  SuR L6-6D09 CDS
atgggatctagattagataaaagtaaagtgattaacagcgcattagagctgcttaatgaggtcggaatcgaaggtttaacaacccgtaaactcgcccagaagctaggtgtagagcagcctacattgtattggcatgtaaaaaataagcgagctctgctcgacgccttagccattgagatgatggataggcacgcaactcacatgtgccctttagaaggggaaagctggcaagattttttacgtaataatgctaaaagtatgagatgtgctttactaagccatcgcgatggagcaaaagtatgtttaggtacacgctggacagaacaacattatgaaactgctgaaaatcaattagcctttttatgccaacaaggtttttcactagagaatgcattatatgcagtgagtgctgtgagggtgtttactttaggttgcgtattgtttgatcaagagagccaagtcgctaaagaagaaagggaaacacctactactgctagtatgccgccattattgcgacaaggttgggaattaaaggatcaccaaggtgcagagccagccttcttattcggccttgaattgatcatatgcggattagaaaaacaacttaaatgcgaaagtgggtcttaa

SEQ ID NO: 626 - DNA, 627 bp, Artificial sequence
  SuR L6-6D10 CDS
atgggatctagattagataaaagtaaagtgattaacagcgcattagagctgcttaatgaggtcggaatcgaaggtttaacaacccgtaaactcgcccagaagctaggtgtagagcagcctacattgtattggcatgtaaaaaataagcgagctctgctcgacgccttagccattgagatgatggataggcacgcaactcacatttgccctttagaaggggaaagctggcaagattttttacgtaataatgctaaaagtatgagatgtgctttactaagccatcgcgatggagcaaaagtatgtttaggtacacgctggacagaacaacaatatgaaactgctgaaaatatgttagcctttttatgccaacaaggtttttcactagagaatgcattatatgcagtgagtgctgtgagggtgtttactttaggttgcgtattgtttgatcaagagagccaagtcgctaaagaagaaagggaaacacctactactgctagtatgccgccattagtgcgacaagctttggaattaaaggatcaccaaggtgcagagccagccttcttattcggccttgaattgatcatatgcggattagaaaaacaacttaaatgcgaaagtgggtcttaa

SEQ ID NO: 627 - DNA, 627 bp, Artificial sequence
  SuR L6-6D12 CDS
atgggatctagattagataaaagtaaagtgattaacagcgcattagagctgcttaatgaggtcggaatcgaaggtttaacaacccgtaaactcgcccagaagctaggtgtagagcagcctacattgtattggcatgtaaaaaataagcgagctctgctcgacgccttagccattgagatgatggataggcacgcaactcacttttgccctttagaaggggaaagctggcaagattttttacgtaataatgctaaaagtatgagatgtgctttactaagccatcgcgatggagcaaaagtatggttaggtacacgctggacagaacaacaatatgaaactgctgaaaatatgttagcctttttatgccaacaaggtttttcactagagaatgcattatatgcagtgagtgctgtgagggtgtttactttaggttgcgtattgtttgatcaagagagacaagtcgctaaagaagaaagggaaacacctactactgctagtatgccgccattattgcgacaagtttgggaattaaaggatcaccaaggtgcagagccagccttcttattcggccttgaattgatcatatgcggattagaaaaacaacttaaatgcgaaagtgggtcttaa

SEQ ID NO: 628 - DNA, 627 bp, Artificial sequence
  SuR L6-6E01 CDS
atgggatctagattagataaaagtaaagtgattaacagcgcattagagctgcttaatgaggtcggaatcgaaggtttaacaacccgtaaactcgcccagaagctaggtgtagagcagcctacattgtattggcatgtaaaaaataagcgagctctgctcgacgccttagccattgagatgatggataggcaccaaactcacttttgccctttagaaggggaaagctggcaagattttttacgtaataatgctaaaagtatgagatgtgctttactaagccatcgcgatggagcaaaagtatgtttaggtacacgctggacagaacaacaatatgaagctgctgaaaatcaattagcctttttatgccaacaaggtttttcactagagaatgcattatatgcaatgagtgctgtgaggaactttactttaggttgcgtattgtttgatcaagagctccaagtcgctaaagaagaaagggaaacacctactactgctagtatgccgccattattgcgacaagtttgggaattaaaggatcaccaaggtgcagagccagccttcttattcggccttgaattgatcatatgcggattagaaaaacaacttaaatgcgaaagtgggtckkra

SEQ ID NO: 629 - DNA, 627 bp, Artificial sequence
  SuR L6-6E02 CDS
atgggatctagattagataaaagtaaagtgattaacagcgcattagagctgcttaatgaggtcggaatcgaaggtttaacaacccgtaaactcgcccagaagctaggtgtagagcagcctacattgtattggcatgtaaaaaataagcgagctctgctcgacgccttagccattgagatgatggataggcaccaaactcacgtttgccctttagaaggggaaagctggcaagattttttacgtaataatgctaaaagtatgagatgtgctttactaagccatcgcgatggagcaaaagtatgtttaggtacacgctggacagaacaaatgtatgaaactgctgaaaatatgttagcctttttatgccaacaaggtttttcactagagaatgcattatatgcaatgagtgctgtgagggtgtttactttaggttgcgtattgtttgatcaagagctccaagtcgctaaagaagaaagggaaacacctactactgctagtatgccgccattattgcgacaagcttgggaattaaaggatcaccaaggtgcagagccagccttcttattcggccttgaattgatcatatgcggattagaaaaacaacttaaatgcgaaagtgggtcttaa

SEQ ID NO: 630 - DNA, 627 bp, Artificial sequence
  SuR L6-6E03 CDS
  misc_feature (437)..(437): n is a, c, g, or t
  misc_feature (602)..(602): n is a, c, g, or t
atgggatctagattagataaaagtaaagtgattaacagcgcattagagctgcttaatgaggtcggaatcgaaggtttaacaacccgtaaactcgcccagaagctaggtgtagagcagcctacattgtattggcatgtaaaaaataagcgagctctgctcgacgccttagccattgagatgatggataggcaccaaactcactattgccctttagaaggggaaagctggcaagattttttacgtaataatgctaaaagtatgagatgtgctttactaagccatcgcgatggagcaaaagtatgtttaggtacacgctggacagaacaacattatgaaactgctgaaaatcaattagcctttttatgccaacaaggtttttcactagagaatgcattatatgcaatgagtgctgtgagggtgtttactttaggttgcgnattgtttgatcaagagagccaagtcgctaaagaagaaagggaaacacctactactgctagtatgccgccattagtgcgacaagtttgggaattaaaggatcaccaaggtgcagagccagccttcttattcggccttgaattgatcatatgcggattagaaaaacnacttaaatgcgaaagtgggtcttaa

SEQ ID NO: 631 - DNA, 627 bp, Artificial sequence
  SuR L6-6E11CDS
atgggatctagattagataaaagtaaagtgattaacagcgcattagagctgcttaatgaggtcggaatcgaaggtttaacaacccgtaaactcgcccagaagctaggtgtagagcagcctacattgtattggcatgtaaaaaataagcgagctctgctcgacgccttagccattgagatgatggataggcaccaaactcactattgccctttagaaggggaaagctggcaagattttttacgtaatactgctaaaagtatgagatgtgctttactaagccatcgcgatggagcaaaagtatgtttaggtacacgctggacagaacaacattatgaaggtgctgaaaatatgttagcctttttatgccaacaaggtttttcactagagaatgcattatatgcagtgagtgctgtgagggtgtttactttaggttgcgtattgtttgatcaagagctccaagtcgctaaagaagaaagggaaacacctactactgctagtatgccgccattagtgcgacaaggttgggaattaaaggatcaccaaggtgcagagccagccttcttattcggccttgaattgatcatatgcggattagaaaaacaacttaaatgcgaaagtgggtcttaa

SEQ ID NO: 632 - DNA, 627 bp, Artificial sequence
  SuR L6-6F03 CDS
atgggatctagattagataaaagtaaagtgattaacagcgcattagagctgcttaatgaggtcggaatcgaaggtttaacaacccgtaaactcgcccagaagctaggtgtagagcagcctacattgtattggcatgtaaaaaataagcgagctctgctcgacgccttagccattgagatgatggataggcaccaaactcacgtttgccctttagaaggggaaagctggcaagattttttacgtaataatgctaaaagtatgagatgtgctttactaagccatcgcgatggagcaaaagtatgtttaggtacacgctggacagaacaacaatatgaagctgctgaaaatcaattagcctttttatgccaacaaggtttttcactagagaatgcattatatgcaatgagtgctgtgagggtgtttactttaggttgcgtattgtttgatcaagagctccaagtcgctaaagaagaaagggaaacacctactactgctagtatgccgccattattgcgacaagtttgggaattaaaggatcaccaaggtgcagagccagccttcttattcggccttgaattgatcatatgcggattagaaaaacaacttaaatgcgaaagtgggtcttaa

SEQ ID NO: 633 - DNA, 627 bp, Artificial sequence
  SuR L6-6F07 CDS
atgggatctagattagataaaagtaaagtgattaacagcgcattagagctgcttaatgaggtcggaatcgaaggtttaacaacccgtaaactcgcccagaagctaggtgtagagcagcctacattgtattggcatgtaaaaaataagcgagctctgctcgacgccttagccattgagatgatggataggcacgcaactcacttgtgccctttagaaggggaaagctggcaagattttttacgtaatactgctaaaagtatgagatgtgctttactaagccatcgcgatggagcaaaagtatgtttaggtacacgctggacagaacaacaatatgaaagtgctgaaaatatgttagcctttttatgccaacaaggtttttcactagagaatgcattatatgcaatgagtgctgtgagggtgtttactttaggttgcgtattgtttgatcaagagagccaagtcgctaaagaagaaagggaaacacctactactgctagtatgccgccattattgcgacaagcttgggaattaaaggatcaccaaggtgcagagccagccttcttattcggccttgaattgatcatatgcggattagaaaaacaacttaaatgcgaaagtgggtcttaa

SEQ ID NO: 634 - DNA, 627 bp, Artificial sequence
  SuR L6-6F08 CDS
atgggatctagattagataaaagtaaagtgattaacagcgcattagagctgcttaatgaggtcggaatcgaaggtttaacaacccgtaaactcgcccagaagctaggtgtagagcagcctacattgtattggcatgtaaaaaataagcgagctctgctcgacgccttagccattgagatgatggataggcaccaaactcactattgccctttagaaggggaaagctggcaagattttttacgtaatactgctaaaagtatgagatgtgctttactaagccatcgcgatggagcaaaagtatgtttaggtacacgctggacagaacaacaatatgaaagtgctgaaaatcaattagcctttttatgccaacaaggtttttcactagagaatgcattatatgcagtgagtgctgtgagggtgtttactttaggttgcgtattgtttgatcaagagctccaagtcgctaaagaagaaagggaaacacctactactgctagtatgccgccattattgcgacaagtttgggaattaaaggatcaccaaggtgcagagccagccttcttattcggccttgaattgatcatatgcggattagaaaaacaacttaaatgcgaaagtgggtcttaa

SEQ ID NO: 635 - DNA, 627 bp, Artificial sequence
  SuR L6-6G01 CDS
atgggatctagattagataaaagtaaagtgattaacagcgcattagagctgcttaatgaggtcggaatcgaaggtttaacaacccgtaaactcgcccagaagctaggtgtagagcagcctacattgtattggcatgtaaaaaataagcgagctctgctcgacgccttagccattgagatgatggataggcacgcaactcacgtttgccctttagaaggggaaagctggcaagattttttacgtaatactgctaaaagtatgagatgtgctttactaagccatcgcgatggagcaaaagtatgtttaggtacacgctggacagaacaacaatatgaaactgctgaaaatatgttagcctttttatgccaacaaggtttttcactagagaatgcattatatgcaatgagtgctgtgagggtgtttactttaggttgcgtattgtttgatcaagagagccaagtcgctaaagaagaaagggaaacacctactactgctagtatgccgccattattgcgacaagtttgggaattaaaggatcaccaaggtgcagagccagccttcttattcggccttgaattgatcatatgcggattagaaaaacaacttaaatgcgaaagtgggtcttaa

SEQ ID NO: 636 - DNA, 627 bp, Artificial sequence
  SuR L7-1A01 CDS
atgggatctagattagataaaagtaaagtgattaacagcgcattagagctgcttaatgaggtcggaatcgaaggtttaacaacccgtaaactcgcccagaagctaggtgtagagcagcctacattgtattggcatgtaaaaaataagcgagctctgctcgacgcattggccattgagatgctggataggcacgcgactcactattgccctttagaaggggaaagctggcaagattttttacgtaataacgctaaaagtatgagatgtgctttactaagtcatcgcgatggagcaaaagtatgtttaggtacaggctttacagaaaagcaatatgaaactgccgaaaatagtctggcctttttatgccaacaaggtttttcactcgagcacgcaatgtatgcaatgcaggctgctggtatttatactttaggttgcgtattgttggatcaagagcttcaagtcgctaaagaagaaagggaaacacctactactgatagtatgccgccattagtccgacaagttctggaattaaaggatcaccaaggtgcagagccagccttcttattcggccttgaattgatcatatgcggattagaaaaacaacttaaatgtgaaagtgggtcttaa

SEQ ID NO: 637 - DNA, 627 bp, Artificial sequence
  SuR L7-1B01 Cds
atgggatctagattagataaaagtaaagcgattaacagcgcattagagctgcttaatgaggtcggaatcgaaggtttaacaacccgtaaactcgcccagaagctaggtgtagagcagcctacattgtattggcatgtaaaaaataagcgagctctgctcgacgcaatggccattgagatgctggataggcacgcgactcactattgccctttagaaggggaaagctggcaagattttttacgtaataacgctaaaagtatgagatgtgctttactaagtcatcgcgatggagcaaaagtatgtttaggtacaggctttacagaacagcaatatgaagctgccgaaaatagtatggcctttttatgccaacaaggtttttcactagagcacgcactgtatgcaatgcaggctgctggtatttttactttaggttgcgtattgttggatcaagagcttcaagtcgctaaagaagaaagggaaacacctactactgatagtatgccgccattagtccgacaagttctggaattaaaggatcaccaaggtgcagagccagccttcttattcggccttgaattgatcatatgcggattagaaaaacaacttaaatgtgaaagtgggtcttaa

SEQ ID NO: 638 - DNA, 627 bp, Artificial sequence
  SuR L7-1C01 CDS
atgggatctagattagataaaagtaaagtgattaacagcgcattagagctgcttaatgaggtcggaatcgaaggtttaacaacccgtaaactcgcccagaagctaggtgtagagcagcctacattgtattggcatgtaaaaaataagcgagctctgctcgacgcattggccattgagatgctggataggcacgcgactcactattgccctttagaaggggaaagctggcaagattttttacgtaataacgctaaaagtatgagatgtgctttactaagtcatcgcgatggagcaaaagtatgtttaggtacaggctttacagaacagatgtatgaagctgccgaaaatagtatggcctttttatgccaacaaggtttttcactagagcacgcaatgtatgcaatgcaggctgttggtatttatactttaggttgcgtattgttggatcaagagcttcaagtcgctaaagaagaaagggaaacacctactactgatagtatgccgccattagtccgacaagttctggaattaaaggatcaccaaggtgcagagccagccttcttattcggccttgaattgatcatatgcggattagaaatacaacttaaatgtgaaagtgggtcttaa

SEQ ID NO: 639 - DNA, 627 bp, Artificial sequence
  SuR L7-1D01 CDS
atgggatctagattagataaaagtaaagygattaacagcgcattagagctgcttaatgaggtcggaatcgaaggtttaacaacccgtaaactcgcccagaagctaggtgtagagcagcctacattgtattggcatgtaaaaaataagcgagctctgctcgacgcaatggccattgagatgctggataggcacgcgactcactattgccctttagaaggggaaagctggcaagattttttacgtaataacgctaaaagtatgagatgtgctttactaagtcatcgcgatggagcaaaagtatgtttaggtacaggctttacagaacagcaatatgaaactgccgaaaatagtctggcctttttatgccaacaaggtttttcactagagaacgcactgtatgcaatgcaggctgttggtatttatactttaggttgcgtattgttggatcaagagcttcaagtcgctaaagaagaaagggaaacacctactactgatagtatgccgccattagtccgacaagttctggaattaaaggatcaccaaggtgcagagccagccttcttattcggccttgaattgatcatatgcggattagaaaaacaacttaaatgtgaaagtgggtcttaa

SEQ ID NO: 640 - DNA, 627 bp, Artificial sequence
  SuRL7-1E01 CDS
  misc_feature (27)..(27): n is a, c, g, or t
atgggatctagattagataaaagtaanccgattaacagcgcattagagctgcttaatgaggtcggaatcgaaggtttaacaacccgtaaactcgcccagaagctaggtgtagagcagcctacattgtattggcatgtaaaaaataagcgagctctgctcgacgcattggccattgagatgctggataggcacgcgactcactattgccctttagaaggggaaagctggcaagattttttacgtaataacgctaaaagtatgagatgtgctttactaagtcatcgcgatggagcaaaagtatgtttaggtacaggctttacagaacagcaatatgaaagtgccgaaaatagtatggcctttttatgccaacaaggtttttcactagagcacgcactgtatgcaatgcaggctgttggtatttttactttaggttgcgtattgttggatcaagagcttcaagtcgctaaagaagaaagggaaacacctactactgatagtatgccgccattactccgacaagctctggaattaaaggatcaccaaggtgcagagccagccttcttattcggccttgaattgatcatatgcggattagaaaaacaacttaaatgtgaaagtgggtcttaa

SEQ ID NO: 641 - DNA, 627 bp, Artificial sequence
  SuR L7-1F01 CDS
atgggatctagattagataaaagtaaagtgattaacagcgcattagagctgcttaatgaggtcggaatcgaaggtttaacaacccgtaaactcgcccagaagctaggtgtagagcagcctacattgtattggcatgtaaaaaataagcgagctctgctcgacgcaatggccattgagatgctggataggcacgcgactcacatctgccctttagaaggggaaagctggcaagattttttacgtaataacgctaaaagtatgagatgtgctttactaagtcatcgcgatggagcaaaagtatgtttaggtacaggctttacagaacagcaatatgaaagtgccgaaaatagtatggcctttttatgccaacaaggtttttcactagagaacgcaatgtatgcaatgcaggctgttggtatttttactttaggttgcgtattgttggatcaagagcttcaagtcgctaaagaagaaagggaaacacctactactgatagtatgccgccattagtccgacaagttctggaattaaaggatcaccaaggtgcagagccagccttcttattcggccttgaattgatcatatgcggattagaaaaacaacttaaatgtgaaagtgggtcttaa

SEQ ID NO: 642 - DNA, 627 bp, Artificial sequence
  SuR L7-1G01 CDS
atgggatctagattagataaaagtaaagtgattaacagcgcattagagctgcttaatgaggtcggaatcgaaggtttaacaacccgtaaactcgcccagaagctaggtgtagagcagcctacattgtattggcatgtaaaaaataagcgagctctgctcgacgcaatggccattgagatgctggataggcacgcgactcacgtctgccctttagaaggggaaagctggcaagattttttacgtaataacgctaaaagtatgagatgtgctttactaagtcatcgcgatggagcaaaagtatgtttaggtacaggctttacagaacagcaatatgaaactgccgaaaatagtatggcctttttatgccaacaaggtttttcactagagaacgcaatgtatgcaatgcaggctgttggtatttttactttaggttgcgtattgttggatcaagagcttcaagtcgctaaagaagaaagggaaacacctactactgatagtatgccgccattagtccgacaagctctggaattaaaggatcaccaaggtgcagagccagccttcttattcggccttgaattgatcatatgcggattagaaaaacaacttaaatgtgaaagtgggtcttaa

SEQ ID NO: 643 - DNA, 627 bp, Artificial sequence
  SuR L7-1C02 CDS
atgggatctagattagataaaagtaaagtgattaacagcgcattagagctgcttaatgaggtcggaatcgaaggtttaacaacccgtaaactcgcccagaagctaggtgtagagcagcctacattgtattggcatgtaaaaaataagcgagctctgctcgacgcaatggccattgagatgctggataggcacgcgactcactattgccctttagaaggggaaagctggcaagattttttacgtaataacgctaaaagtatgagatgtgctttactaagtcatcgcgatggagcaaaagtatgtttaggtacaggctttacagaacagatgtatgaaactgccgaaaatagtatggcctttttatgccaacaaggtttttcactagagcacgcactgtatgcaatgcaggctgttggtatttatactgtaggttgcgtattgttggatcaagagcttcaagtcgctaaagaagaaagggaaacacctactactgatagtatgccgccattagtccgacaaggtcttgaattaaaggatcaccaaggtgcagagccagccttcttattcggccttgaattgatcatatgcggattagaaaaacaacttaaatgtgaaagtgggtcttaa

SEQ ID NO: 644 - DNA, 627 bp, Artificial sequence
  SuR L7-1D02 CDS
  misc_feature (330)..(330): n is a, c, g, or t
atgggatctagattagataaaagtaaagcgattaacagcgcattagagctgcttaatgaggtcggaatcgaaggtttaacaacccgtaaactcgcccagaagctaggtgtagagcagcctacattgtattggcatgtaaaaaataagcgagctctgctcgacgcaatggccattgagatgctggataggcacgcgactcactattgccctttagaaggggaaagctggcaagattttttacgtaataacgctaaaagtatgagatgtgctttactaagtcatcgcgatggagcaaaagtatgtttaggtacaggctttacagaacagcantatgaagctgccgaaaatagtatggcctttttatgccaacaaggtttttcactagagaacgcaatgtatgcaatgcaggctgttggtatttatactttaggttgcgtattgttggatcaagagcttcaagtcgctaaagaagaaagggaaacacctactactgatagtatgccgccattagtccgacaagttctggaattaaaggatcaccaaggtgcagagccagccttcttattcggccttgaattgatcatatgcggattagaaaaacaacttaaatgtgaaagtgggtcttaa

SEQ ID NO: 645 - DNA, 627 bp, Artificial sequence
  SuR L7-1E02 CDS
  misc_feature (166)..(166): n is a, c, g, or t
  misc_feature (329)..(330): n is a, c, g, or t
  misc_feature (413)..(413): n is a, c, g, or t
  misc_feature (415)..(415): n is a, c, g, or t
atgggatctagattagataaaagtaaagtgattaacagcgcattagagctgcttaatgaggtcggaatcgaaggtttaacaacccgtaaactcgcccagaagctaggtgtagagcagcctacattgtattggcatgtaaaaaataagcgagctctgctcgacgcantggccattgagatgctggataggcacgcgactcactattgccctttagaaggggaaagctggcaagattttttacgtaataacgctaaaagtatgagatgtgctttactaagtcatcgcgatggagcaaaagtatgtttaggtacaggctttacagaacagcnntatgaaactgccgaaaatagtctggcctttttatgccaacaaggtttttcactagagaacgcaatgtatgcaatgcaggctgntngtatttatactttaggttgcgtattgttggatcaagagcttcaagtcgctaaagaagaaagggaaacacctactactgatagtatgccgccattagtccgacaagctctggaattaaaggatcaccaaggtgcagagccagccttcttattcggccttgaattgatcatatgcggattagaaaaacaacttaaatgtgaaagtgggtcttaa

SEQ ID NO: 646 - DNA, 627 bp, Artificial sequence
  SuR L7-1F02 CDS
atgggatctagattagataaaagtaaagtgattaacagcgcattagagctgcttaatgaggtcggaatcgaaggtttaacaacccgtaaactcgcccagaagctaggtgtagagcagcctacattgtattggcatgtaaaaaataagcgagctctgctcgacgcaatggccattgagatgctggataggcacgcgactcactatggccctttagaaggggaaagctggcaagattttttacgtaataacgctaaaagtatgagatgtgctttactaagtcatcgcgatggagcaaaagtatgtttaggtacaggctttacagaacagcaatatgaaactgccgaaaatagtatggcctttttatgccaacaaggtttttcactagagaacgcaatgtatgcaatgcaggctgtttgtatttatactttaggttgcgtattgttggatcaagagcttcaagtcgctaaagaagaaagggaaacacctactacagatagtatgccgccattagtccgacaagttctggaattaaaggatcaccaaggtgcagagccagccttcttattcggccttgaattgatcatatgcggattagaaaaacaacttaaatgtgaaagtgggtcttaa

SEQ ID NO: 647 - DNA, 627 bp, Artificial sequence
  SuR L7-1G02 CDS
atgggatctagattagataaaagtaaagygattaacagcgcattagagctgcttaatgaggtcggaatcgaaggtttaacaacccgtaaactcgcccagaagctaggtgtagagcagcctacattgtattggcatgtaaaaaataagcgagctctgctcgacgcaatggccattgagatgctggataggcacgcgactcactattgccctttagaaggggaaagctggcaagattttttacgtaataacgctaaaagtatgagatgtgctttactaagtcatcgcgatggagcaaaagtatgtttaggtacaggctttacagaaaagatgtatgaaggtgccgaaaatagtatggcctttttatgccaacaaggtttttcactagagcacgcaatgtatgcaatgcaggctgctggtatttttactttaggttgcgtattgttggatcaagagcttcaagtcgctaaagaagaaagggaaacacctactactgatagtatgccgccattagtccgacaagctctggaattaaaggatcaccaaggtgcagagccagccttcttattcggccttgaattgatcatatgcggattagaaaaacaacttaaatgtgaaagtgggtcttaa

SEQ ID NO: 648 - DNA, 627 bp, Artificial sequence
  SuR L7-1H02 CDS
atgggatctagattagataaaagtaaagtgattaacagcgcattagagctgcttaatgaggtcggaatcgaaggtttaacaacccgtaaactcgcccagaagctaggtgtagagcagcctacattgtattggcatgtaaaaaataagcgagctctgctcgacgcaatggccattgagatgctggataggcacgcgactcactattgccctttagaaggggaaagctggcaagattttttacgtaataacgctaaaagtatgagatgtgctttactaagtcatcgcgatggagcaaaagtatgtttaggtacaggctttacagaacagcaatatgaaactgccgaaaatagtctggcctttttatgccaacaaggtttttcactagagcacgcaatgtatgcaatgcaggctgttggtatttttactttaggttgcgtattgttggatcaagagcttcaagtcgctaaagaagaaagggaaacacctactactgatagtatgccgccattagtccgacaagctctggaattaaaggatcaccaaggtgcagagccagccttcttattcggccttgaattgatcatatgcggattagaaaaacaacttaaatgtgaaagtgggtcttaa

SEQ ID NO: 649 - DNA, 627 bp, Artificial sequence
  SuR L7-1C03 CDS
atgggatctagattagataaaagtaaagcgattaacagcgcattagagctgcttaatgaggtcggaatcgaaggtttaacaacccgtaaactcgcccagaagctaggtgtagagcagcctacattgtattggcatgtaaaaaataagcgagctctgctcgacgcaatggccattgagatgctggataggcacgcgactcacgtctgccctttagaaggggaaagctggcaagattttttacgtaataacgctaaaattatgagatgtgctttactaagtcatcgcgatggagcaaaagtatgtttaggtacaggctttacagaacagcaatatgaaactgccgaaaatagtctggcctttttatgccaacaaggtttttcactagagcacgcactgtatgcaatgcaggctgctggtatttttactttaggttgcgtattgttggatcaagagcttcaagtcgctaaagaagaaagggaaacacctactactgatagtatgccgccattagtccgacaagctctggaattaaatgatcaccaaggtgcagagccagccttcttattcggccttgaattgatcatatgcggattagaaaaacaacttaaatgtgaaagtgggtcttaa

SEQ ID NO: 650 - DNA, 627 bp, Artificial sequence
  SuR L7-1E03 CDS
atgggatctagattagataaaagtaaagcgattaacagcgcattagagctgcttaatgaggtcggaatcgaaggtttaacaacccgtaaactcgcccagaagctaggtgtagagcagcctacattgtattggcatgtaaaaaataagcgagctctgctcgacgcattggccattgagatgctggataggcacgcgactcactattgccctttagaaggggaaagctggcaagattttttacgtaataacgctaaaagtatgagatgtgctttactaagtcatcgcgatggagcaaaagtatgtttaggtacaggctttacagaacagatgtatgaaactgccgaaaatagtatggcctttttatgccaacaaggtttttcactagagaacgcaatgtatgcaatgcaggctgctggtatttatactttaggttgcgtattgttggatcaagagcttcaagtcgctaaagaagaaagggaaacacctactactgatagtatgccgccattagtccgacaagttctggaattaaaggatcaccaaggtgcagagccagccttcttattcggccttgaattgatcatatgcggattagaaaaacaacttaaatgtgaaagtgggtcttaa

SEQ ID NO: 651 - DNA, 627 bp, Artificial sequence
  SuR L7-1A04 CDS
atgggatctagattagataaaagtaaagtgattaacagcgcattagagctgcttaatgaggtcggaatcgaaggtttaacaacccgtaaactcgcccagaagctaggtgtagagcagcctacattgtattggcatgtaaaaaataagcgagctctgctcgacgcaatggccattgagatgctggataggcacgcgactcactattgccctttagaagggaaaagctggcaagattttttacgtaataacgctaaaagtatgagatgtgctttactaagtcatcgcgatggagcaaaagtatgtttaggtacaggctttacagaacagcaatatgaaagtgccgaaaatagtatggcctttttatgccaacaaggtttttcactagagcacgcaatgtatgcaatgcaggctgctggtatttttactttaggttgcgtattgttggatcaagagcttcaagtcgctaaagaagaaagggaaacacctactactgatagtatgccgccattactccgacaagctctggaattaaaggatcaccaaggtgcagagccagccttcttattcggccttgaattgatcatatgcggattagaaaaacaacttaaatgtgaaagtgggtcttaa

SEQ ID NO: 652 - DNA, 627 bp, Artificial sequence
  SuR L7-1C04 CDS
atgggatctagattagataaaagtaaagygattaacagcgcattagagctgcttaatgaggtcggaatcgaaggtttaacaacccgtaaactcgcccagaagctaggtgtagagcagcctacattgtattggcatgtaaaaaataagcgagctctgctcgacgcattggccattgagatgctggataggcacgcgactcactattgccctttagaaggggaaagctggcaagattttttacgtaataacgctaaaagtatgagatgtgctttactaagtcatcgcgatggagcaaaagtatgtttaggtacaggctttacagaacagatgtatgaaagtgccgaaaatagtctggcctttttatgccaacaaggtttttcactagagcacgcaatgtatgcaatgcaggctgctggtatttatactttaggttgcgtattgttggatcaagagcttcaagtcgctaaagaagaaagggaaacacctactactgatagtatgccgccattagtccgacaaggtctggaattaaaggatcaccaaggtgcagagccagccttcttattcggccttgaattgatcatatgcggattagaaaaacaacttaaatgtgaaagtgggtcttaa

SEQ ID NO: 653 - DNA, 627 bp, Artificial sequence
  SuR L7-1D04 CDS
atgggatctagattagataaaagtaaagcgattaacagcgcattagagctgcttaatgaggtcggaatcgaaggtttaacaacccgtaaactcgcccagaagctaggtgtagagcagcctacattgtattggcatgtaaaaaataagcgagctctgctcgacgcaatggccattgagatgctggataggcacgcgactcactattgccctttagaaggggaaagctggcaagattttttacgtaataacgctaaaagtatgagatgtgctttactaagtcatcgcgatggagcaaaagtatgtttaggtacaggctttacagaacagcaatatgaaggtgccgaaaatagtatggcctttttatgccaacaaggtttttcactagagaacgcaatgtatgcaatgcaggctgttggtatttttactttaggttgcgtattgttggatcaagagcttcaagtcgctaaagaagaaagggaaacacctactactgatagtatgccgccattagtccgacaaggtctggaattaaaggatcaccaaggtgcagagccagccttcttattcggccttgaattgatcatatgcggattagaaaaacaacttaaatgtgaaagtgggtcttaa

SEQ ID NO: 654 - DNA, 627 bp, Artificial sequence
  SuR L7-1E04 CDS
atgggatctagattagataaaagtaaagygattaacagcgcattagagctgcttaatgaggtcggaatcgaaggtttaacaacccgtaaactcgcccagaagctaggtgtagagcagcctacattgtattggcatgtaaaaaataagcgagctctgctcgacgcaatggccattgagatgctggataggcacgcgactcactattgccctttagaaggggaaagctggcaagattttttacgtaataacgctaaaagtatgagatgtgctttactaagtcatcgcgatggagcaaaagtatgtttaggtacaggctttacagaacagcaatatgaaactgccgaaaatagtctggcctttttatgccaacaaggtttttcactagagcacgcactgtatgcaatgcaggctgttggtatttatactttaggttgcgtattgttggatcaagagcttcaagtcgctaaagaagaaagggaaacacctactactgatagtatgccgccattagctcgacaagctctggaattaaaggatcaccaaggtgcagagccagccttcttattcggccttgaattgatcatatgcggattagaaaaacaacttaaatgtgaaagtgggtcttaa

SEQ ID NO: 655 - DNA, 627 bp, Artificial sequence
  SuR L7-1F04 CDS
atgggatctagattagataaaagtaaagygattaacagcgcattagagctgcttaatgaggtcggaatcgaaggtttaacaacccgtaaactcgcccagaagctaggtgtagagcagcctacattgtattggcatgtaaaaaataagcgagctctgctcgacgcattggccattgagatgctggataggcacgcgactcactattgccctttagaaggggaaagctggcaagattttttacgtaataacgctaaaagtatgagatgtgctttactaagtcatcgcgatggagcaaaagtatgtttaggtacaggctttacagaacagcactatgaaactgccgaaaatagtatggcctttttatgccaacaaggtttttcactagagaacgcactgtatgcaatgcaggctgttggtatttttactttaggttgcgtattgttggatcaagagcttcaagtcgctaaagaagaaagggaaacacctactactgatagtatgccgccattagtccgacaagctctggaattaaaggatcaccaaggtgcagagccagccttcttattcggccttgaattgatcatatgcggattagaaaaacaacttaaatgtgaaagtgggtcttaa

SEQ ID NO: 656 - DNA, 627 bp, Artificial sequence
  SuR L7-1G04 CDS
  misc_feature (29)..(29): n is a, c, g, or t
atgggatctagattagataaaagtaaagngattaacagcgcattagagctgcttaatgaggtcggaatcgaaggtttaacaacccgtaaactcgcccagaagctaggtgtagagcagcctacattgtattggcatgtaaaaaataagcgagctctgctcgacgcaatggccattgagatgctggataggcacgcgactcactattgccctttagaaggggaaagctggcaagattttttacgtaataacgctaaaagtatgagatgtgctttactaagtcatcgcgatggagcaaaagtatgtttaggtacaggctttacagaacagcaatatgaaagtgccgaaaatagtatggcctttttatgccaacaaggtttttcactagagaacgcaatgtatgcaatgcaggctgttggtatttatactttaggttgcgtattgttggatcaagagcttcaagtcgctaaagaagaaagggaaacacctactactgatagtatgccgccattactccgacaagttctggaattaaaggatcaccaaggtgcagagccagccttcttattcggccttgaattgatcatatgcggattagaaaaacaacttaaatgtgaaagtgggtcttaa

SEQ ID NO: 657 - DNA, 627 bp, Artificial sequence
  SuR L7-1H04 CDS
atgggatctagattagataaaagtaaagygattaacagcgcattagagctgcttaatgaggtcggaatcgaaggtttaacaacccgtaaactcgcccagaagctaggtgtagagcagcctacattgtattggcatgtaaaaaataagcgagctctgctcgacgcattggccattgagatgctggataggcacgcgactcactattgccctttagaaggggaaagctggcaagattttttacgtaataacgctaaaagtatgagatgtgctttactaagtcatcgcgatggagcaaaagtatgtttaggtacaggctttacagaaaagcaatatgaagctgccgaaaatagtctggcctttttatgccaacaaggtttttcactagagcacgcactgtatgcaatgcaggctgctggtatttatactttaggttgcgtattgttggatcaagagcttcaagtcgctaaagaagaaagggaaacacctactactgatagtatgccgccattagtccgacaagctctggaattaaaggatcaccaaggtgcagagccagccttcttattcggccttgaattgatcatatgcggattagaaaaacaacttaaatgtgaaagtgggtcttaa

SEQ ID NO: 658 - DNA, 627 bp, Artificial sequence
  SuR L7-1A05 CDS
atgggatctagattagataaaagtaaagtgattaacagcgcattagagctgcttaatgaggtcggaatcgaaggtttaacaacccgtaaactcgcccagaagctaggtgtagagcagcctacattgtattggcatgtaaaaaataagcgagctctgctcgacgcaatggccattgagatgctggataggcacgcgactcactattgccctttagaaggggaaagctggcaagattttttacgtaataacgctaaaagtatgagatgtgctttactaagtcatcgcgatggagcaaaagtatgtttaggtacaggctttacagaacagcactatgaaactgccgaaaatagtatggcctttttatgccaacaaggtttttcactagagcacgcactgtatgcaatgcaggctgctggtatttatactttaggttgcgtattgttggatcaagagcttcaagtcgctaaagaagaaagggaaacacctactactgatagtatgccgccattagtccgacaagctctggaattaaaggatcaccaaggtgcagagccagccttcttattcggccttgaattgatcatatgcggattagaaaaacaacttaaatgtgaaagtgggtcttaa

SEQ ID NO: 659 - DNA, 627 bp, Artificial sequence
  SuR L7-1C05 CDS
atgggatctagattagataaaagtaaagygattaacagcgcattagagctgcttaatgaggtcggaatcgaaggtttaacaacccgtaaactcgcccagaagctaggtgtagagcagcctacattgtattggcatgtaaaaaataagcgagctctgctcgacgcaatggccattgagatgctggataggcacgcgacacactattgccctttagaaggggaaagctggcaagattttttacgtaataacgctaaaagtatgagatgtgctttactaagtcatcgcgatggagcaaaagtatgtttaggtacaggctttacagaacagcactatgaaactgccgaaaatagtatggcctttttatgccaacaaggtttttcactagagaacgcaatgtatgcaatgcaggctgttggtatttatactttaggttgcgtattgttggatcaagagcttcaagtcgctaaagaagaaagggaaacacctactactgatagtatgccgccattagtccgacaagctctggaattaaaggatcaccaaggtgcagagccagccttcttattcggccttgaattgatcatatgcggattagaaaaacaacttaaatgtgaaagtgggtcttaa

SEQ ID NO: 660 - DNA, 627 bp, Artificial sequence
  SuR L7-1E05 CDS
atgggatctagattagataaaagtaaagtgattaacagcgcattagagctgcttaatgaggtcggaatcgaaggtttaacaacccgtaaactcgcccagaagctaggtgtagagcagcctacattgtattggcatgtaaaaaataagcgagctctgcttgacgcaatggccattgagatgctggataggcacgcgactcactattgccctttagaaggggaaagctggcaagattttttacgtaataacgctaaaagtatgagatgtgctttactaagtcatcgcgatggagcaaaagtatgtttaggtacaggctttacagaacagcaatatgaaactgccgaaaatagtatggcctttttatgcaaacaaggtttttcactagagaacgcaatgtatgcaatgcaggctgttggtatttatactttaggttgcgtattgttggatcaagagcttcaagtcgctaaagaagaaagggaaacacctactactgatagtatgccgccattagtccgacaagttctggaattaaaggatcaccaaggtgcagagccagccttcttattcggccttgaattgatcatatgcggattagaaaaacaacttaaatgtgaaagtgggtcttaa

SEQ ID NO: 661 - DNA, 627 bp, Artificial sequence
  SuR L7-1F05 CDS
  misc_feature (166)..(166): n is a, c, g, or t
  misc_feature (338)..(338): n is a, c, g, or t
  misc_feature (352)..(352): n is a, c, g, or t
  misc_feature (521)..(521): n is a, c, g, or t
atgggatctagattagataaaagtaaagtgattaacagcgcattagagctgcttaatgaggtcggaatcgaaggtttaacaacccgtaaactcgcccagaagctaggtgtagagcagcctacattgtattggcatgtaaaaaataagcgagctctgctcgacgcantggccattgagatgctggataggcacgcgactcactattgccctttagaaggggaaagctggcaagattttttacgtaataacgctaaaagtatgagatgtgctttactaagtcatcgcgatggagcaaaagtatgtttaggtacaggctttacagaacagcactatgaaantgccgaaaatagtntggcctttttatgccaacaaggtttttcactagagcacgcactgtatgcaatgcaggctgttggtatttatactttaggttgcgtattgttggatcaagagcttcaagtcgctaaagaagaaagggaaacacctactactgatagtatgccgccattagtccgacaagntctggaattaaaggatcaccaaggtgcagagccagccttcttattcggccttgaattgatcatatgcggattagaaaaacaacttaaatgtgaaagtgggtcttaa

SEQ ID NO: 662 - DNA, 627 bp, Artificial sequence
  SuR L7-1A06 CDS
atgggatctagattagataaaagtaaagtgattaacagcgcattagagctgcttaatgaggtcggaatcgaaggtttaacaacccgtaaactcgcccagaagctaggtgtagagcagcctacattgtattggcatgtaaaaaataagcgagctctgctcgacgcattggccattgagatgctggataggcacgcgactcactattgccctttagaaggggaaagctggcaagattttttacgtaataacgctaaaagtatgagatgtgctttactaagtcatcgcgatggagcaaaagtatgtttaggtacaggctttacagaacagcactatgaaagtgccgaaaatagtctggcctttttatgccaacaaggtttttcactagagaacgcaatgtatgcaatgcaggctgttggtatttttactttaggttgcgtattgttggatcaagagcttcaagtcgctaaagaagaaagggaaacacctactactgatagtatgccgccattagtccgacaagttctggaattaaaggatcaccaaggtgcagagccagccttcttattcggccttgaattgatcatatgcggattagaaaaacaacttaaatgtgaaagtgggtcttaa

SEQ ID NO: 663 - DNA, 627 bp, Artificial sequence
  SuR L7-1B06 CDS
atgggatctagattagataaaagtaaagcgattaacagcgcattagagctgcttaatgaggtcggaatcgaaggtttaacaacccgtaaactcgcccagaagctaggtgtagagcagcctacattgtattggcatgtaaaaaataagcgagctctgctcgacgcaatggccattgagatgctggataggcacgcgactcactattgccctttagaaggggaaagctggcaagattttttacgtaataacgctaaaagtatgagatgtgctttactaagtcatcgcgatggagcaaaagtatgtttaggtacaggctttacagaacagcaatatgaaactgccgaaaatagtctggcctttttatgccaacaaggtttttcactagagaacgcactgtatgcaatgcaggctgttggtatttatactttaggttgcgtattgttggatcaagagcttcaagtcgctaaagaagaaagggaaacacctactactgatagtatgccgccattagtccgccaagttctggaattaaaggatcaccaaggtgcagagccagccttcttattcggccttgaattgatcatatgcggattagaaaaacaacttaaatgtgaaagtgggtcttaa

SEQ ID NO: 664 - DNA, 627 bp, Artificial sequence
  SuR L7-1D06 CDS
atgggatctagattagataaaagtaaagtgattaacagcgcattagagctgcttaatgaggtcggaatcgaaggtttaacaacccgtaaactcgcccagaagctaggtgtagagcagcctacattgtattggcatgtaaaaaataagcgagctctgctcgacgcaatggccattgagatgctggataggcacgcgactcactattgccctttagaaggggaaagctggcaagattttttacgtaataacgctaaaagtatgagatgtgctttactaagtcatcgcgatggagcaaaagtatgtttaggtacaggctttacagaacagcaatatgaagctgccgaaaatagtatggcctttttatgccaacaagatttttcactagagcacgcaatgtatgcaatgcaggctgttggtatttatactttaggttgcgtattgttggatcaagagcttcaagtcgctaaagaagaaagggaaacacctactactgatagtatgccgccattagtccgacaaggtctggaattaaaggatcaccaaggtgcagagccagccttcttattcggccttgaattgatcatatgcggattagaaaaacaacttaaatgtgaaagtgggtcttaa

SEQ ID NO: 665 - DNA, 627 bp, Artificial sequence
  SuR L7-1E06 CDS
  misc_feature (337)..(338): n is a, c, g, or t
atgggatctagattagataaaagtaaagtgattaacagcgcattagagctgcttaatgaggtcggaatcgaaggtttaacaacccgtaaactcgcccagaagctaggtgtagagcagcctacattgtattggcatgtaaaaaataagcgagctctgctcgacgcaatggccattgagatgctggataggcacgcgactcactattgccctttagaagggaaaagctggcaagattttttacgtaataacgctaaaagtatgagatgtgctttactaagtcatcgcgatggagcaaaagtatgtttaggtacaggctttacagaacagcactatgaanntgccgaaaatagtatggcctttttatgccaacaaggtttttcactagagcacgcaatgtatgcaatgcaggctgctggtatttttactttaggttgcgtattgttggatcaagagcttcaagtcgctaaagaagaaagggaaacacctactactgatagtatgccgccattactccgacaagctctggaattaaaggatcaccaaggtgcagagccagccttcttattcggccttgaattgatcatatgcggattagaaaaacaacttaaatgtgaaagtgggtcttaa

SEQ ID NO: 666 - DNA, 627 bp, Artificial sequence
  SuR L7-1F06 CDS
atgggatctagattagataaaagtaaagtgattaacagcgcattagagctgcttaatgaggtcggaatcgaaggtttaacaacccgtaaactcgcccagaagctaggtgtagagcagcctacattgtattggcatgtaaaaaataagcgagctctgctcgacgcaatggccattgagatgctggataggcacgcgactcactattgccctttagaaggggaaagctggcaagattttttacgtaataacgctaaaagtatgagatgtgctttactaagtcatcgcgatggagcaaaagtatgtttaggtacaggctttacagaacagcaatatgaaactgccgaaaatagtctggcctttttatgccaacaaggtttttcactagagcacgcaatgtatgcaatgcaggctgctggtatttatactttaggttgcgtattgttggatcaagagcttcaagtcgctaaagaagaaagggaaacacctactactgatagtatgccgccattagtccgacaagctctggaattaaaggatcaccaaggtgcagagccagccttcttattcggccttgaattgatcatatgcggattagaaaaacaacttaaatgtgaaagtgggtcttaa

SEQ ID NO: 667 - DNA, 627 bp, Artificial sequence
  SuR L7-1G06 CDS
atgggatctagattagataaaagtaaagygattaacagcgcattagagctgcttaatgaggtcggaatcgaaggtttaacaacccgtaaactcgcccagaagctaggtgtagagcagcctacattgtattggcatgtaaaaaataagcgagctctgctcgacgcaatggccattgagatgctggataggcacgcgactcactattgccctttagaaggggaaagctggcaagattttttacgtaataacgctaaaagtatgagatgtgctttactaagtcatcgcgatggagcaaaagtatgtttaggtacaggctttacagaacagcaatatgaaactgccgaaaatagtatggcctttttatgccaacaaggtttttcactagagaacgcactgtatgcaatgcaggctgttggtatttatactttaggttgcgtattgttggatcaagagcttcaagtcgctaaagaagaaagggaaacacctactactgatagtatgccgccattagtccgacaagctctggaattaaaggatcaccaaggtgcagagccagccttcttattcggccttgaattgatcatatgcggattagaaaaacaacttaaatgtgaaagtgggtcttaa

SEQ ID NO: 668 - DNA, 627 bp, Artificial sequence
  SuR L7-1H06 CDS
atgggatctagattagataaaagtaaagcgattaacagcgcattagagctgcttaatgaggtcggaatcgaaggtttaacaacccgtaaactcgcccagaagctaggtgtagagcagcctacattgtattggcatgtaaaaaataagcgagctctgctcgacgcattggccattgagatgctggataggcacgcgactcactattgccctttagaaggggaaagctggcaagattttttacgtaataacgctaaaagtatgagatgtgctttactaagtcatcgcgatggagcaaaagtatgtttaggtacaggctttacagaaaagcactatgaaactgccgaaaatagtatggcctttttatgccaacaaggtttttcactagagcacgcaatgtatgcaatgcaggctgttggtatttatactttaggttgcgtattgttggatcaagagcttcaagtcgctaaagaagaaagggaaacacctactactgatagtatgccgccattagtccgacaagttctggaattaaaggatcaccaaggtgcagagccagccttcttattcggccttgaattgatcatatgcggattagaaaaacaacttaaatgtgaaagtgggtcttaa

SEQ ID NO: 669 - DNA, 627 bp, Artificial sequence
  SuR L7-1A07 CDS
atgggatctagattagataaaagtaaagygattaacagcgcattagagctgcttaatgaggtcggaatcgaaggtttaacaacccgtaaactcgcccagaagctaggtgtagagcagcctacattgtattggcatgtaaaaaataagcgagctctgctcgacgcattggccattgagatgctggataggcacgcgactcactattgccctttagaaggggaaagctggcaagattttttacgtaataacgctaaaagtatgagatgtgctttactaagtcatcgcgatggagcaaaagtatgtttaggtacaggctttacagaaaagcaatatgaagctgccgaaaatagtatggcctttttatgccaacaaggtttttcactagagcacgcaatgtatgcaatgcaggctgctggtatttatactttaggttgcgtattgttggatcaagagcttcaagtcgctaaagaagaaagggaaacacctactactgatagtatgccgccattagtccgacaagttctggaattaaaggatcaccaaggtgcagagccagccttcttattcggccttgaattgatcatatgcggattagaaaaacaacttaaatgtgaaagtgggtcttaa

SEQ ID NO: 670 - DNA, 627 bp, Artificial sequence
  SuR L7-1B07 CDS
atgggatctagattagataaaagtaaagygattaacagcgcattagagctgcttaatgaggtcggaatcgaaggtttaacaacccgtaaactcgcccagaagctaggtgtagagcagcctacattgtattggcatgtaaaaaataagcgagctctgctcgacgcaatggccattgagatgctggataggcacgcgactcactattgccctttagaaggggaaagctggcaagattttttacgtaataacgctaaaagtatgagatgtgctttactaagtcatcgcgatggagcaaaagtatgtttaggtacaggctttacagaacagcaatatgaaactgccgaaaatagtatggcctttttatgccaacaaggtttttcactagagaacgcaatgtatgcaatgcaggctgcttgtatttatactttaggttgcgtattgttggatcaagagcttcaagtcgctaaagaagaaagggaaacacctactactgatagtatgccgccattagtccgacaagttctggaattaaaggatcaccaaggtgcagagccagccttcttattcggccttgaattgatcatatgcggattagaaaaacaacttaaatgtgaaagtgggtcttaa

SEQ ID NO: 671 - DNA, 627 bp, Artificial sequence
  SuR L7-1C07 CDS
atgggatctagattagataaaagtaaagygattaacagcgcattagagctgcttaatgaggtcggaatcgaaggtttaacaacccgtaaactcgcccagaagctaggtgtagagcagcctacattgtattggcatgtaaaaaataagcgagctctgctcgacgcaatggccattgagatgctggataggcacgcgactcactattgccctttagaaggggaaagctggcaagattttttacgtaataacgctaaaagtatgagatgtgctttactaagtcatcgcgatggagcaaaagtatgtttaggtacaggctttacagaacagcaatatgaaactgccgaaaatagtctggcctttttatgccaacaaggtttttcactagagcacgcactgtatgcaatgcaggctgctggtatttttactttaggttgcgtattgttggatcaagagcttcaagtcgctaaagaagaaagggaaacacctactactgatagtatgccgccattagtccgacaagctctggaattaaaggatcaccaaggtgcagagccagccttcttattcggccttgaattgatcatatgcggattagaaaaacaacttaaatgtgaaagtgggtcttaa

SEQ ID NO: 672 - DNA, 627 bp, Artificial sequence
  SuR L7-1D07 CDS
atgggatctagattagataaaagtaaagygattaacagcgcattagagctgcttaatgaggtcggaatcgaaggtttaacaacccgtaaactcgcccagaagctaggtgtagagcagcctacattgtattggcatgtaaaaaataagcgagctctgctcgacgcaatggccattgagatgctggataggcacgcgactcacgtgtgccctttagaaggggaaagctggcaagattttttacgtaataacgctaaaagtatgagatgtgctttactaagtcatcgcgatggagcaaaagtatgtttaggtacaggctttacagaacagcaatatgaaggtgccgaaaatagtatggcctttttatgccaacaaggtttttcactagagcacgcaatgtatgcaatgcaggctgttggtatttatactttaggttgcgtattgttggatcaagagcttcaagtcgctaaagaagaaagggaaacacctactactgatagtatgccgccattagtccgacaagctctggaattaaaggatcaccaaggtgcagagccagccttcttattcggccttgaattgatcatatgcggattagaaaaacaacttaaatgtggaagtgggtcttaa

SEQ ID NO: 673 - DNA, 627 bp, Artificial sequence
  SuR L7-1E07 CDS
atgggatctagattagataaaagtaaagtgattaacagcgcattagagctgcttaatgaggtcggaatcgaaggtttaacaacccgtaaactcgcccagaagctaggtgtagagcagcctacattgtattggcatgtaaaaaataagcgagctctgctcgacgcattggccattgagatgctggataggcacgcgactcacatctgccctttagaaggggaaagctggcaagattttttacgtaataacgctaaaagtatgagatgtgctttactaagtcatcgcgatggagcaaaagtatgtttaggtacaggctttacagaacagatgtatgaaactgccgaaaatagtatggcctttttatgccaacaaggtttttcactagagaacgcaatgtatgcaatgcaggctgctggtatttttactttaggttgcgtattgttggatcaagagcttcaagtcgctaaagaagaaagggaaacacctactactgatagtatgccgccattagtccgacaagttctggaattaaaggatcaccaaggtgcagagccagccttcttattcggccttgaattgatcatatgcggattagaaaaacaacttaaatgtgaaagtgggtcttaa

SEQ ID NO: 674 - DNA, 627 bp, Artificial sequence
  SuR L7-1F07 CDS
atgggatctagattagataaaagtaaagygattaacagcgcattagagctgcttaatgaggtcggaatcgaaggtttaacaacccgtaaactcgcccagaagctaggtgtagagcagcctacattgtattggcatgtaaaaaataagcgagctctgctcgacgcattggccattgagatgctggataggcacgcgactcactattgccctttagaaggggaaagctggcaagattttttacgtaataacgctaaaagtatgagatgtgctttactaagtcatcgcgatggagcaaaagtatgtttaggtacaggctttacagaacagatgtatgaaagtgccgaaaatagtctggcctttttatgccaacaaggtttttcactagagcacgcaatgtatgcaatgcaggctgctggtatttttactttaggttgcgtattgttggatcaagagcttcaagtcgctaaagaagaaagggaaacacctactactgatagtatgccgccattagtccgacaagttctggaattaaaggatcaccaaggtgcagagccagccttcttattcggccttgaattgatcatatgcggattagaaaaacaacttaaatgtgaaagtgggtcttaa

SEQ ID NO: 675 - DNA, 627 bp, Artificial sequence
  SuR L7-1G07 CDS
  misc_feature (595)..(595): n is a, c, g, or t
atgggatctagattagataaaagtaaagtgattaacagcgcattagagctgcttaatgaggtcggaatcgaaggtttaacaacccgtaaactcgcccagaagctaggtgtagagcagcctacattgtattggcatgtaaaaaataagcgagctctgctcgacgcaatggccattgagatgctggataggcacgcgactcactattgccctttagaaggggaaagctggcaagattttttacgtaataacgctaaaagtatgagatgtgctttactaagtcatcgcgatggagcaaaagtatgtttaggtacaggctttacagaacagcactatgaaagtgccgaaaatagtatggcctttttatgccaacaaggtttttcactagagcacgcaatgtatgcaatgcaggctgctggtatttatactttaggttgcgtattgttggatcaagagcttcaagtcgctaaagaagaaaggcaaacacctactactgatagtatgccgccattagtccgacaagctctggaattaaaggatcaccaaggtgcagagccagccttcttattcggccttgaattgatcatatgcggattanaaaaacaacttaaatgtgaaagtgggtcttaa

SEQ ID NO: 676 - DNA, 627 bp, Artificial sequence
  SuR L7-1A08 CDS
atgggatctagattagataaaagtaaagygattaacagcgcattagagctgcttaatgaggtcggaatcgaaggtttaacaacccgtaaactcgcccagaagctaggtgtagagcagcctacattgtattggcatgtaaaaaataagcgagctctgctcgacgcaatggccattgagatgctggataggcacgcgactcacttgtgccctttagaaggggaaagctggcaagattttttacgtaataacgctaaaagtatgagatgtgctttactaagtcatcgcgatggagcaaaagtatgtttaggtacaggctttacagaacagcaatatgaaactgccgaaaatagtatggcctttttatgccaacaaggtttttcactagagcacgcaatgtatgcaatgcaggctgttggtatttatactttaggttgcgtattgttggatcaagagcttcaagtcgctaaagaagaaagggaaacacctactactgatagtatgccgccattactccgacaagctctggaattaaaggatcaccaaggtgcagagccagccttcttattcggccttgaattgatcatatgcggattagaaaaacaacttaaatgtgaaagtgggtcttaa

SEQ ID NO: 677 - DNA, 627 bp, Artificial sequence
  SuR L7-1C08 CDS
  misc_feature (166)..(166): n is a, c, g, or t
  misc_feature (330)..(330): n is a, c, g, or t
atgggatctagattagataaaagtaaagtgattaacagcgcattagagctgcttaatgaggtcggaatcgaaggtttaacaacccgtaaactcgcccagaagctaggtgtagagcagcctacattgtattggcatgtaaaaaataagcgagctctgctcgacgcantggccattgagatgctggataggcacgcgactcactattgccctttagaaggggaaagctggcaagattttttacgtaataacgctaaaagtatgagatgtgctttactaagtcatcgcgatggagcaaaagtatgtttaggtacaggctttacagaacagcantatgaagctgccgaaaatagtatggcctttttatgccaacaaggtttttcactagagcacgcaatgtatgcaatgcaggctgctggtatttatactttaggttgcgtattgttggatcaagagcttcaagtcgctaaagaagaaagggaaacacctactactgatagtatgccgccattagtccgacaagttctggaattaaaggatcaccaaggtgcagagccagccttcttattcggccttgaattgatcatatgcggattagaaaaacaacttaaatgtgaaagtgggtcttaa

SEQ ID NO: 678 - DNA, 627 bp, Artificial sequence
  SuR L7-1D08 CDS
  misc_feature (511)..(511): n is a, c, g, or t
atgggatctagattagataaaagtaaagtgattaacagcgcattagagctgcttaatgaggtcggaatcgaaggtttaacaacccgtaaactcgcccagaagctaggtgtagagcagcctacattgtattggcatgtaaaaaataagcgagctctgctcgacgcaatggccattgagatgctggataggcacgcgactcactattgccctttagaaggggaaagctggcaagattttttacgtaataacgctaaaagtatgagatgtgctttactaagtcatcgcgatggagcaaaagtatgtttaggtacaggctttacagaacagcaatatgaaactgccgaaaatagtatggcctttttatgccaacaaggtttttcactagagcacgcactgtatgcaatgcaggctgctggtatttatactttaggttgcgtattgttggatcaagagcttcaagtcgctaaagaagaaagggaaacacctactactgatagtatgccgccattantccgacaagttctggaattaaaggatcaccaaggtgcagagccagccttcttattcggccttgaattgatcatatgcggattagaaaaacaacttaaatgtgaaagtgggtcttaa

SEQ ID NO: 679 - DNA, 627 bp, Artificial sequence
  SuR L7-1E08 CDS
atgggatctagattagataaaagtaaagygattaacagcgcattagagctgcttaatgaggtcggaatcgaaggtttaacaacccgtaaactcgcccagaagctaggtgtagagcagcctacattgtattggcatgtaaaaaataagcgagctctgctcgacgcaatggccattgagatgctggataggcacgcgactcactattgccctttagaaggggaaagctggcaagattttttacgtaataacgctaaaagtatgagatgtgctttactaagtcatcgcgatggagcaaaagtatgtttaggtacaggctttacagaacagcaatatgaaactgccgaaaatagtctggcctttttatgccaacaaggtttttcactagagcacgcaatgtatgcaatgcaggctgttggtatttttactttaggttgcgtattgttggatcaagagcttcaagtcgctaaagaagaaagggaaacacctactactgatagtatgccgccattagtccgacaagttctggaattaaaggatcaccaaggtgcagagccagccttcttattcggccttgaattgatcatatgcggattagaaaaacaacttaaatgtgaaagtgggtcttaa

SEQ ID NO: 680 - DNA, 627 bp, Artificial sequence
  SuR L7-1F08 CDS
atgggatctagattagataaaagtaaagtgattaacagcgcattagagctgcttaatgaggtcggaatcgaaggtttaacaacccgtaaactcgcccagaagctaggtgtagagcagcctacattgtattggcatgtaaaaaataagcgagctctgctcgacgcaatggccattgagatgctggataggcacgcgactcactattgccctttagaaggagaaagctggcaagattttttacgtaataacgctaaaagtatgagatgtgctttactaagtcatcgcgatggagcaaaagtatgtttaggtacaggctttacagaacagcaatatgaaactgccgaaaatagtctggcctttttatgccaacaaggtttttcactagagaacgcactgtatgcaatgcaggctgttggtatttatactttaggttgcgtattgttggatcaagagcttcaagtcgctaaagaagaaagggaaacacctactactgatagtatgccgccattagtccgacaagctctggaattaaaggatcaccaaggtgcagagccagccttcttattcggccttgaattgatcatatgcggattagaaaaacaacttaaatgtgaaagtgggtcttaa

SEQ ID NO: 681 - DNA, 627 bp, Artificial sequence
  SuR L7-1G08 CDS
atgggatctagattagataaaagtaaagtgattaacagcgcattagagctgcttaatgaggtcggaatcgaaggtttaacaacccgtaaactcgcccagaagctaggtgtagagcagcctacattgtattggcatgtaaaaaataagcgagctctgctcgacgcaatggccattgagatgctggataggcacgcgactcactattgccctttagaaggggaaagctggcaagattttttacgtaataacgctaaaagtatgagatgtgctttactaagtcatcgcgatggagcaaaagtatgtttaggtacaggctttacagaacagcactatgaaactgccgaaaatagtctggcctttttatgccaacaaggtttttcactagagcacgcaatgtatgcaatgcaggctgttggtatttatactttaggttgcgtattgttggatcaagagcttcaagtcgctaaagaagaaagggaaacacctactactgatagtatgccgccattagtccgacaagctctggaattaaaggatcaccaaggtgcagagccagccttcttattcggccttgaattgatcatatgcggattagaaaaacaacttaaatgtgaaagtgggtcttaa

SEQ ID NO: 682 - DNA, 627 bp, Artificial sequence
  SuR L7-1A09 CDS
atgggatctagattagataaaagtaaagygattaacagcgcattagagctgcttaatgaggtcggaatcgaaggtttaacaacccgtaaactcgcccagaagctaggtgtagagcagcctacattgtattggcatgtaaaaaataagcgagctctgctcgacgcaatggccattgagatgctggataggcacgcgactcactattgccctttagaagaggaaagctggcaagattttttacgtaataacgctaaaagtatgagatgtgctttactaagtcatcgcgatggagcaaaagtatgtttaggtacaggctttacagaacagcaatatgaagctgccgaaaatagtatggcctttttatgccaacaaggtttttcactagagcacgcactgtatgcaatgcaggctgctggtatttatactttaggttgcgtattgttggatcaagagcttcaagtcgctaaagaagaaagggaaacacctactactgatagtatgccgccattagtccgacaagctctggaattaaaggatcaccaaggtgcagagccagccttcttattcggccttgaattgatcatatgcggattagaaaaacaacttaaatgtgaaagtgggtcttaa

SEQ ID NO: 683 - DNA, 627 bp, Artificial sequence
  SuR L7-1B09 CDS
atgggatctagattagataaaagtaaagtgattaacagcgcattagagctgcttaatgaggtcggaatcgaaggtttaacaacccgtaaactcgcccagaagctaggtgtagagcagcctacattgtattggcatgtaaaaaataagcgagctctgctcgacgcaatggccattgagatgctggataggcacgcgactcactattgccctttagaaggggaaagctggcaagattttttacgtaataacgctaaaagtatgagatgtgctttactaagtcatcgcgatggagcaaaagtatgtttaggtacaggctttacagaacagcaatatgaaactgccgaaaatagtctggcctttttatgccaacaaggtttttcactagagaacgcaatgtatgcaatgcaggctgctggtatttatactttaggttgcgtattgttggatcaagagcttcaagtcgctaaagaagaaagggaaacacctactactgatagtatgccgccattagtccgacaaggtctggaattaaaggatcaccaaggtgcagagccagccttcttattcggtcttgaattgatcatatgcggattagaaaaacaacttaaatgtgaaagtgggtcttaa

SEQ ID NO: 684 - DNA, 627 bp, Artificial sequence
  SuR L7-1C09 CDS
atgggatctagattagataaaagtaaagcgattaacagcgcattagagctgcttaatgaggtcggaatcgaaggtttaacaacccgtaaactcgcccagaagctaggtgtagagcagcctacattgtattggcatgtaaaaaataagcgagctctgctcgacgcattggccattgagatgctggataggcacgcgactcactattgccctttagaaggggaaagctggcaagattttttacgtaataacgctaaaagtatgagatgtgctttactaagtcatcgcgatggagcaaaagtatgtttaggtacaggctttacagaacagcactatgaaactgccgaaaatagtctggcctttttatgccaacaaggtttttcactagagaacgcaatgtatgcaatgcaggctgttggtatttttactttaggttgcgtattgttggatcaagagcttcaagtcgctaaagaagaaagggaaacacctactactgatagtatgccgccattagtccgacaagttctggaattaaaggatcaccaaggtgcagagccagccttcttattcggccttgaattgatcatatgcggattagaaaaacaacttaaatgtgaaagtgggtcttaa

SEQ ID NO: 685 - DNA, 627 bp, Artificial sequence
  SuR L7-1D09 CDS
atgggatctagattagataaaagtaaagtgattaacagcgcattagagctgcttaatgaggtcggaatcgaaggtttaacaacccgtaaactcgcccagaagctaggtgtagagcagcctacattgtattggcatgtaaaaaataagcgagctctgctcgacgcaatggccattgagatgctggataggcacgcgactcactattgccctttagaaggggaaagctggcaagattttttacgtaataacgctaaaagtatgagatgtgctttactaagtcatcgcgatggagcaaaagtatgtttaggtacaggctttacagaacagcaatatgaaagtgccgaaaatagtctggcctttttatgccaacaaggtttttcactagagaacgcaatgtatgcaatgcaggctgctggtatttatactttaggttgcgtattgttggatcaagagcttcaagtcgctaaagaagaaagggaaacacctactactgatagtatgccgccattactccgacaagctctggaattaaaggatcaccaaggtgcagagccagccttcttattcggccttgaattgatcatatgcggattagaaaaacaacttaaatgtgaaagtgggtcttaa

SEQ ID NO: 686 - DNA, 627 bp, Artificial sequence
  SuR L7-1E09 CDS
atgggatctagattagataaaagtaaagygattaacagcgcattagagctgcttaatgaggtcggaatcgaaggtttaacaacccgtaaactcgcccagaagctaggtgtagagcagcctacattgtattggcatgtaaaaaataagcgagctctgctcgacgcaatggccattgagatgctggataggcacgcgactcactattgccctttagaaggggaaagctggcaagattttttacgtaataacgctaaaagtatgagatgtgctttactaagtcaacgcgatggagcaaaagtatgtttaggtacaggctttacagaacagcaatatgaaggtgccgaaaatagtctggcctttttatgccaacaaggtttttcactagagcacgcactgtatgcaatgcaggctgctggtatttttactttaggttgcgtattgttggatcaagagcttcaagtcgctaaagaagaaagggaaacacctactactgatagtatgccgccattagtccgacaagctctggaattaaaggatcaccaaggtgcagagccagccttcttattcggccttgaattgatcatatgcggattagaaaaacaacttaaatgtgaaagtgggtcttaa

SEQ ID NO: 687 - DNA, 627 bp, Artificial sequence
  SuR L7-1G09 CDS
atgggatctagattagataaaagtaaagtgattaacagcgcattagagctgcttaatgaggtcggaatcgaaggtttaacaacccgtaaactcgcccagaagctaggtgtagagcagcctacattgtattggcatgtaaaaaataagcgagctctgctcgacgcaatggccattgagatgctggataggcacgcgactcactattgccctttagaaggggaaagctggcaagattttttacgtaataacgctaaaagtatgagatgtgctttactaagtcatcgcgatggagcaaaagtatgtttaggtacaggctttacagaacagcaatatgaaactgccgaaaatagtatggcctttttatgccaacaaggtttttcactagagaacgcactgtatgcaatgcaggctgctggtatttatactttaggttgcgtattgttggatcaagagcttcaagtcgctaaagaagaaagggaaacacctactactgatagtatgccgccattagtccgacaaggtctggaattaaaggatcaccaaggtgcagagccagccttcttattcggccttgaattgatcatatgcggattagaaaaacaacttaaatgtgaaagtgggtcttaa

SEQ ID NO: 688 - DNA, 627 bp, Artificial sequence
  SuR L7-1A10 CDS
atgggatctagattagataaaagtaaagtgattaacagcgcattagagctgcttaatgaggtcggaatcgaaggtttaacaacccgtaaactcgcccagaagctaggtgtagagcagcctacattgtattggcatgtaaaaaataagcgagctctgctcgacgcattggccattgagatgctggataggcacgcgactcactattgccctttagaaggggaaagctggcaagattttttacgtaataacgctaaaagtatgagatgtgctttactaagtcatcgcgatggagcaaaagtatgtttaggtacaggctttacagaacagatgtatgaaagtgccgaaaatagtatggcctttttatgccaacaaggtttttcactagagaacgcaatgtatgcaatgcaggctgctggtatttatactttaggttgcgtattgttggatcaagagcttcaagtcgctaaagaagaaagggaaacacctactactgatagtatgccgccattagtccgacaaggtctggaattaaaggatcaccaaggtgcagagccagccttcttattcggccttgaattgatcatatgcggattagaaaaacaacttaaatgtgaaagtgggtcttaa

SEQ ID NO: 689 - DNA, 627 bp, Artificial sequence
  SuR L7-1B10 CDS
atgggatctagattagataaaagtaaagtgattaacagcgcattagagctgcttaatgaggtcggaatcgaaggtttaacaacccgtaaactcgcccagaagctaggtgtagagcagcctacattgtattggcatgtaaaaaataagcgagctctgctcgacgcaatggccattgagatgctggataggcacgcgactcactattgccctttagaaggggaaagctggcaagattttttacgtaataacgctaaaagtatgagatgtgctttactaagtcatcgcgatggagcaaaagtatgtttaggtacaggctttacagaacagcaatatgaaggtgccgaaaatagtatggcctttttatgccaacaaggtttttcactagagaacgcaatgtatgcaatgcaggctgttggtatttttactttaggttgcgtattgttggatcaagagcttcaagtcgctaaagaagaaagggaaacacctactactgatagtatgccgccattagtccgacaagctctggaattaaaggatcaccaaggtgcagagccagccttcttattcggccttgaattgatcatatgcggattagaaaaacaacttaaatgtgaaagtgggtcttaa

SEQ ID NO: 690 - DNA, 627 bp, Artificial sequence
  SuR L7-1C10 CDS
  misc_feature (203)..(204): n is a, c, g, or t
  misc_feature (330)..(330): n is a, c, g, or t
  misc_feature (337)..(338): n is a, c, g, or t
  misc_feature (394)..(394): n is a, c, g, or t
atgggatctagattagataaaagtaaagtgattaacagcgcattagagctgcttaatgaggtcggaatcgaaggtttaacaacccgtaaactcgcccagaagctaggtgtagagcagcctacattgtattggcatgtaaaaaataagcgagctctgctcgacgcattggccattgagatgctggataggcacgcgactcactnntgccctttagaaggggaaagctggcaagattttttacgtaataacgctaaaagtatgagatgtgctttactaagtcatcgcgatggagcaaaagtatgtttaggtacaggctttacagaacagcantatgaanntgccgaaaatagtatggcctttttatgccaacaaggtttttcactagagcacgcantgtatgcaatgcaggctgctggtatttttactttaggttgcgtattgttggatcaagagcttcaagtcgctaaagaagaaagggaaacacctactactgatagtatgccgccattactccgacaagctctggaattaaaggatcaccaaggtgcagagccagccttcttattcggccttgaattgatcatatgcggattagaaaaacaacttaaatgtgaaagtgggtcttaa

SEQ ID NO: 691 - DNA, 627 bp, Artificial sequence
  SuR L7-1D10 CDS
atgggatctagattagataaaagtaaagtgattaacagcgcattagagctgcttaatgaggtcggaatcgaaggtttaacaacccgtaaactcgcccagaagctaggtgtagagcagcctacattgtattggcatgtaaaaaataagcgagctctgctcgacgcaatggccattgagatgctggataggcacgcgactcacatctgccctttagaaggggaaagctggcaagattttttacgtaataacgctaaaagtatgagatgtgctttactaagtcatcgcgatggagcaaaagtatgtttaggtacaggctttacagaacagcaatatgaaactgccgaaaatagtctggcctttttatgccaacaaggtttttcactagagaacgcactgtatgcaatgcaggctgctggtatttttactttaggttgcgtattgttggatcaagagcttcaagtcgctaaagaagaaagggaaacacctactactgatagtatgccgccattagtccgacaagttctggaattaaaggatcaccaaggtgcagagccagccttcttattcggccttgaattgatcatatgcggattagaaaaacaacttaaatgtgaaagtgggtcttaa

SEQ ID NO: 692 - DNA, 627 bp, Artificial sequence
  SuR L7-1F10 CDS
  misc_feature (203)..(204): n is a, c, g, or t
  misc_feature (337)..(337): n is a, c, g, or t
  misc_feature (388)..(388): n is a, c, g, or t
  misc_feature (415)..(415): n is a, c, g, or t
  misc_feature (512)..(512): n is a, c, g, or t
  misc_feature (521)..(521): n is a, c, g, or t
atgggatctagattagataaaagtaaagtgattaacagcgcattagagctgcttaatgaggtcggaatcgaaggtttaacaacccgtaaactcgcccagaagctaggtgtagagcagcctacattgtattggcatgtaaaaaataagcgagctctgctcgacgcattggccattgagatgctggataggcacgcgactcactnntgccctttagaaggggaaagctggcaagattttttacgtaataacgctaaaagtatgagatgtgctttactaagtcatcgcgatggagcaaaagtatgtttaggtacaggctttacagaacagctgtatgaanctgccgaaaatagtctggcctttttatgccaacaaggtttttcactagagnacgcactgtatgcaatgcaggctgctngtatttatactttaggttgcgtattgttggatcaagagcttcaagtcgctaaagaagaaagggaaacacctactactgatagtatgccgccattagnccgacaagntctggaattaaaggatcaccaaggtgcagagccagccttcttattcggccttgaattgatcatatgcggattagaaaaacaacttaaatgtgaaagtgggtcttaa

SEQ ID NO: 693 - DNA, 627 bp, Artificial sequence
  SuR L7-1A11 CDS
atgggatctagattagataaaagtaaagtgattaacagcgcattagagctgcttaatgaggtcggaatcgaaggtttaacaacccgtaaactcgcccagaagctaggtgtagagcagcctacattgtattggcatgtaaaaaataagcgagctctgctcgacgcattggccattgagatgctggataggcacgcgactcactattgccctttagaaggggaaagctggcaagattttttacgtaataacgctaaaagtatgagatgtgctttactaagtcatcgcgatggagcaaaagtatgtttaggtacaggctttacagaaaagcaatatgaaagtgccgaaaatagtctggcctttttatgccaacaaggtttttcactagagcacgcaatgtatgcaatgcaggctgctggtatttatactttaggttgcgtattgttggatcaagagcttcaagtcgctaaagaagaaagggaaacacctactactgatagtatgccgccattagtccgacaagctctggaattaaaggatcaccaaggtgcagagccagccttcttattcggccttgaattgatcatatgcggattagaaaaacaacttaaatgtgaaagtgggtcttaa

SEQ ID NO: 694 - DNA, 627 bp, Artificial sequence
  SuR L7-1B11 CDS
  misc_feature (511)..(511): n is a, c, g, or t
atgggatctagattagataaaagtaaagtgattaacagcgcattagagctgcttaatgaggtcggaatcgaaggtttaacaacccgtaaactcgcccagaagctaggtgtagagcagcctacattgtattggcatgtaaaaaataagcgagctctgctcgacgcaatggccattgagatgctggataggcacgcgactcactattgccctttagaaggggaaagctggcaagattttttacgtaataacgctaaaagtatgagatgtgctttactaagtcatcgcgatggagcaaaagtatgtttaggtacaggctttacagaacagcaatatgaaagtgccgaaaatagtatggcctttttatgccaacaaggtttttcactagagcacgcaatgtatgcaatgcaggctgctggtatttatactttaggttgcgtattgttggatcaagagcttcaagtcgctaaagaagaaagggaaacacctactactgatagtatgccgccattantccgacaagttctggaattaaaggatcaccaaggtgcagagccagccttcttattcggccttgaattgatcatatgcggattagaaaaacaacttaaatgtgaaagtgggtcttaa

SEQ ID NO: 695 - DNA, 627 bp, Artificial sequence
  SuR L7-1C11 CDS
  misc_feature (166)..(166): n is a, c, g, or t
  misc_feature (352)..(352): n is a, c, g, or t
  misc_feature (415)..(415): n is a, c, g, or t
atgggatctagattagataaaagtaaagtgattaacagcgcattagagctgcttaatgaggtcggaatcgaaggtttaacaacccgtaaactcgcccagaagctaggtgtagagcagcctacattgtattggcatgtaaaaaataagcgagctctgctcgacgcantggccattgagatgctggataggcacgcgactcactattgccctttagaaggggaaagctggcaagattttttacgtaataacgctaaaagtatgagatgtgctttactaagtcatcgcgatggagcaaaagtatgtttaggtacaggctttacagaacagatgtatgaaactgccgaaaatagtntggcctttttatgccaacaaggtttttcactagagcacgcaatgtatgcaatgcaggctgctngtatttatactttaggttgcgtattgttggatcaagagcttcaagtcgctaaagaagaaagggaaacacctactactgatagtatgccgccattagctcgacaaggtctggaattaaaggatcaccaaggtgcagagccagccttcttattcggccttgaattgatcatatgcggattagaaaaacaacttaaatgtgaaagtgggtcttaa

SEQ ID NO: 696 - DNA, 627 bp, Artificial sequence
  SuR L7-1E11 CDS
  misc_feature (330)..(330): n is a, c, g, or t
atgggatctagattagataaaagtaaagtgattaacagcgcattagagctgcttaatgaggtcggaatcgaaggtttaacaacccgtaaactcgcccagaagctaggtgtagagcagcctacattgtattggcatgtaaaaaataagcgagctctgctcgacgcaatggccattgagatgctggataggcacgcgactcactattgccctttagaaggggaaagctggcaagattttttacgtaataacgctaaaagtatgagatgtgctttactaagtcatcgcgatggagcaaaagtatgtttaggtacaggctttacagaacagcantatgaagctgccgaaaatagtatggcctttttatgccaacaaggtttttcactagagcacgcaatgtatgcaatgcaagctgctggtatttttactttaggttgcgtattgttggatcaagagcttcaagtcgctaaagaagaaagggaaacacctactactgatagtatgccgccattagtccgacaagctctggaattaaaggatcaccaaggtgcagagccagccttcttattcggccttgaattgatcatatgcggattagaaaaacaacttaaatgtgaaagtgggtcttaa

SEQ ID NO: 697 - DNA, 627 bp, Artificial sequence
  SuR L7-1A12 CDS
  misc_feature (204)..(204): n is a, c, g, or t
atgggatctagattagataaaagtaaagtgattaacagcgcattagagctgcttaatgaggtcggaatcgaaggtttaacaacccgtaaactcgcccagaagctaggtgtagagcagcctacattgtattggcatgtaaaaaataagcgagctctgctcgacgcaatggccattgagatgctggataggcacgcgactcacatntgccctttagaaggggaaagctggcaagattttttacgtaataacgctaaaagtatgagatgtgctttactaagtcatcgcgatggagcaaaagtatgtttaggtacaggctttacagaacagcaatatgaaggtgccgaaaatagtctggcctttttatgccaacaaggtttttcactagagcacgcaatgtatgcaatgcaggctgttggtatttatactttaggttgcgtattgttggatcaagagcttcaagtcgctaaagaagaaagggaaacacctactactgatagtatgccgccattagtccgacaaggtctggaattaaaggatcaccaaggtgcagagccagccttcttattcggccttgaattgatcatatgcggattagaaaaacaacttaaatgtgaaagtgggtcttaa

SEQ ID NO: 698 - DNA, 627 bp, Artificial sequence
  SuR L7-1C12 CDS
  misc_feature (330)..(330): n is a, c, g, or t
  misc_feature (337)..(337): n is a, c, g, or t
  misc_feature (422)..(422): n is a, c, g, or t
  misc_feature (595)..(595): n is a, c, g, or t
atgggatctagattagataaaagtaaagtgattaacagcgcattagagctgcttaatgaggtcggaatcgaaggtttaacaacccgtaaactcgcccagaagctaggtgtagagcagcctacattgtattggcatgtaaaaaataagcgagctctgctcgacgcaatggccattgagatgctggataggcacgcgactcactattgccctttagaaggggaaagctggcaagattttttacgtaataacgctaaaagtatgagatgtgctttactaagtcatcgcgatggagcaaaagtatgtttaggtacaggctttacagaacagcantatgaanctgccgaaaatagtctggcctttttatgccaacaaggtttttcactagagcacgcaatgtatgcaatgcaggctgctggtatttntactttaggttgcgtattgttggatcaagagcttcaagtcgctaaagaagaaagggaaacacctactactgatagtatgccgccattagctcgacaaggtctggaattaaaggatcaccaaggtgcagagccagccttcttattcggccttgaattgatcatatgcggattanaaaaacaacttaaatgtgaaagtgggtcttaa

SEQ ID NO: 699 - DNA, 627 bp, Artificial sequence
  SuR L7-1F12 CDS
  misc_feature (461)..(461): n is a, c, g, or t
  misc_feature (583)..(583): n is a, c, g, or t
  misc_feature (595)..(595): n is a, c, g, or t
atgggatctagattagataaaagtaaagtgattaacagcgcattagagctgcttaatgaggtcggaatcgaaggtttaacaacccgtaaactcgcccagaagctaggtgtagagcagcctacattgtattggcatgtaaaaaataagcgagctctgctcgacgcaatggccattgagatgctggataggcacgcgactcactattgccctttagaaggggaaagctggcaagattttttacgtaataacgctaaaagtatgagatgtgctttactaagtcatcgcgatggagcaaaagtatgtttaggtacaggctttacagaacagcaatatgaaagtgccgaaaatagtatggcctttttatgccaacaaggtttttcactagagcacgcaatgtatgcaatgcaggctgctggtatttatactttaggttgcgtattgttggatcaagagcttcaagncgctaaagaagaaagggaaacacctactactgatagtatgccgccattactccgacaagttctggaattaaatgatcaccaaggtgcagagccagccttcttattcggccttgaattgatcntatgcggattanaaaaacaacttaaatgtgaaagtgggtcttaa

SEQ ID NO: 700 - DNA, 627 bp, Artificial sequence
  SuR L7-1G12 CDS
  misc_feature (279)..(279): n is a, c, g, or t
  misc_feature (417)..(417): n is a, c, g, or t
  misc_feature (461)..(461): n is a, c, g, or t
  misc_feature (481)..(481): n is a, c, g, or t
  misc_feature (498)..(498): n is a, c, g, or t
  misc_feature (518)..(518): n is a, c, g, or t
  misc_feature (522)..(522): n is a, c, g, or t
  misc_feature (556)..(556): n is a, c, g, or t
  misc_feature (583)..(583): n is a, c, g, or t
  misc_feature (600)..(600): n is a, c, g, or t
  misc_feature (603)..(603): n is a, c, g, or t
atgggatctagattagataaaagtaaagtgattaacagcgcattagagctgcttaatgaggtcggaatcgaaggtttaacaacccgtaaactcgcccagaagctaggtgtagagcagcctacattgtattggcatgtaaaaaataagcgagctctgctcgacgcaatggccattgagatgctggataggcacgcgactcactattgccctttagaaggggaaagctggcaagattttttacgtaataacgctaaaagtatgagatgtgctttactaagncatcgcgatggagcaaaagtatgtttaggtacaggctttacagaacagcaatatgaaggtgccgaaaatagtctggcctttttatgccaacaaggtttttcactagagcacgcaatgtatgcaatgcaggctgctggnatttatactttaggttgcgtattgttggatcaagagcttcaagncgctaaagaagaaagggaancccctactactgatagnatgccgccattagctcgacnaggnctggaattaaaggatcaccaaggtccagagccanccttcttattcggccttgaattgatcntatgcggattagaaaancancttaaatgtgaaagtgggtcttaa

SEQ ID NO: 701 - DNA, 627 bp, Artificial sequence
  SuR L7-2A01 CDS
atgggatctagattagataaaagtaaagtgattaacagcgcattagagctgcttaatgaggtcggaatcgaaggtttaacaacccgtaaactcgcccagaagctaggtgtagagcagcctacattgtattggcatgtaaaaaataagcgagctctgctcgacgcaatggccattgagatgctggataggcacgcgactcacgtgtgccctttagaaggggaaagctggcaagattttttacgtaataacgctaaaagtatgagatgtgctttactaagtcatcgcgatggagcaaaagtatgtttaggtacaggctttacagaacagcaatatgaaggtgccgaaaatagtatggcctttttatgccaacaaggtttttcactagagcacgcaatgtatgcaatgcaggctgttggtatttatactttaggttgcgtattgttggatcaagagcttcaagtcgctaaagaagaaagggaaacacctactactgatagtatgccgccattagtccgacaagctctggaattaaaggatcaccaaggtgcagagccagccttcttattcggccttgaattgatcatatgcggattagaaaaacaacttaaatgtggaagtgggtcttaa

SEQ ID NO: 702 - DNA, 627 bp, Artificial sequence
  SuR L7-2B01 CDS
  misc_feature (166)..(166): n is a, c, g, or t
  misc_feature (203)..(203): n is a, c, g, or t
  misc_feature (325)..(325): n is a, c, g, or t
  misc_feature (328)..(330): n is a, c, g, or t
  misc_feature (352)..(352): n is a, c, g, or t
  misc_feature (388)..(388): n is a, c, g, or t
  misc_feature (415)..(415): n is a, c, g, or t
  misc_feature (422)..(422): n is a, c, g, or t
  misc_feature (513)..(513): n is a, c, g, or t
atgggatctagattagataaaagtaaagtgattaacagcgcattagagctgcttaatgaggtcggaatcgaaggtttaacaacccgtaaactcgcccagaagctaggtgtagagcagcctacattgtattggcatgtaaaaaataagcgagctctgctcgacgcantggccattgagatgctggataggcacgcgactcactngtgccctttagaaggggaaagctggcaagattttttacgtaataacgctaaaagtatgagatgtgctttactaagtcatcgcgatggagcaaaagtatgtttaggtacaggctttacagaanagnnntatgaaggtgccgaaaatagtntggcctttttatgccaacaaggtttttcactagagnacgcaatgtatgcaatgcaggctgctngtatttntactttaggttgcgtattgttggatcaagagcttcaagtcgctaaagaagaaagggaaacacctactactgatagtatgccgccattagcncgacaagttctggaattaaaggatcaccaaggtgcagagccagccttcttattcggccttgaattgatcatatgcggattagaaaaacaacttaaatgtgaaagtgggtcttaa

SEQ ID NO: 703 - DNA, 627 bp, Artificial sequence
  SuR L7-2D01 CDS
  misc_feature (325)..(325): n is a, c, g, or t
  misc_feature (328)..(328): n is a, c, g, or t
  misc_feature (394)..(394): n is a, c, g, or t
  misc_feature (413)..(413): n is a, c, g, or t
  misc_feature (512)..(512): n is a, c, g, or t
atgggatctagattagataaaagtaaagtgattaacagcgcattagagctgcttaatgaggtcggaatcgaaggtttaacaacccgtaaactcgcccagaagctaggtgtagagcagcctacattgtattggcatgtaaaaaataagcgagctctgctcgacgcaatggccattgagatgctggataggcacgcgactcactattgccctttagaaggggaaagctggcaagattttttacgtaataacgctaaaagtatgagatgtgctttactaagtcatcgcgatggagcaaaagtatgtttaggtacaggctttacagaanagntgtatgaaagtgccgaaaatagtatggcctttttatgccaacaaggtttttcactagagcacgcantgtatgcaatgcaggctgntggtatttatactttaggttgcgtattgttggatcaagagcttcaagtcgctaaagaagaaagggaaacacctactactgatagtatgccgccattagntcgacaagctctggaattaaaggatcaccaaggtgcagagccagccttcttattcggccttgaattgatcatatgcggattagaaaaacaacttaaatgtgaaagtgggtcttaa

SEQ ID NO: 704 - DNA, 627 bp, Artificial sequence
  SuR L7-2E01 CDS
atgggatctagattagataaaagtaaagtgattaacagcgcattagagctgcttaatgaggtcggaatcgaaggtttaacaacccgtaaactcgcccagaagctaggtgtagagcagcctacattgtattggcatgtaaaaaataagcgagctctgctcgacgcattggccattgagatgctggataggcacgcgactcactattgccctttagaaggggaaagctggcaagattttttacgtaataacgctaaaagtatgagatgtgctttactaagtcatcgcgatggagcaaaagtatgtttaggtacaggctttacagaaaagcaatatgaaactgccgaaaatagtatggcctttttatgccaacaaggtttttcactagagaacgcactgtatgcaatgcaggctgttggtatttatactttaggttgcgtattgttggatcaagagcttcaagtcgctaaagaagaaagggaaacacctactactgatagtatgccgccattagtccgacaagctctggaattaaaggatcaccaaggtgcagagccagccttcttattcggccttgaattgatcatatgcggattagaaaaacaacttaaatgtgaaagtgggtcttaa

SEQ ID NO: 705 - DNA, 627 bp, Artificial sequence
  SuR L7-2F01 CDS
atgggatctagattagataaaagtaaagtgattaacagcgcattagagctgcttaatgaggtcggaatcgaaggtttaacaacccgtaaactcgcccagaagctaggtgtagagcagcctacattgtattggcatgtaaaaaataagcgagctctgctcgacgcattggccattgagatgctggataggcacgcgactcactattgccctttagaaggggaaagctggcaagattttttacgtaataacgctaaaagtatgagatgtgctttactaagtcatcgcgatggagcaaaagtatgtttaggtacaggctttacagaacagatgtatgaaactgccgaaaatagtctggcctttttatgccaacaaggtttttcactagagcacgcaatgtatgcaatgcaggctgctggtatttttactttaggttgcgtattgttggatcaagagcttcaagtcgctaaagaagaaagggaaacacctactactgatagtatgccgccattagtccgacaagttctggaattaaaggatcaccaaggtgcagagccagccttcttattcggccttgaattgatcatatgcggattagaaaaacaacttaaatgtgaaagtgggtcttaa

SEQ ID NO: 706 - DNA, 627 bp, Artificial sequence
  SuR L7-2G01 CDS
  misc_feature (325)..(325): n is a, c, g, or t
atgggatctagattagataaaagtaaagtgattaacagcgcattagagctgcttaatgaggtcggaatcgaaggtttaacaacccgtaaactcgcccagaagctaggtgtagagcagcctacattgtattggcatgtaaaaaataagcgagctctgctcgacgcaatggccattgagatgctggataggcacgcgactcactattgccctttagaaggggaaagctggcaagattttttacgtaataacgctaaaagtatgagatgtgctttactaagtcatcgcgatggagcaaaagtatgtttaggtacaggctttacagaanagctgtatgaaagtgccgaaaatagtctggcctttttatgccaacaaggtttttcactagagcacgcaatgtatgcaatgcaggctgttggtatttatactttaggttgcgtattgttggatcaagagcttcaagtcgctaaagaagaaagggaaacacctactactgatagtatgccgccattagtccgacaagttctggaattaaaggatcaccaaggtgcagagccagccttcttattcggccttgaattgatcatatgcggattagaaaaacaacttaaatgtgaaagtgggtcttaa

SEQ ID NO: 707 - DNA, 627 bp, Artificial sequence
  SuR L7-2H01 CDS
atgggatctagattagataaaagtaaagtgattaacagcgcattagagctgcttaatgaggtcggaatcgaaggtttaacaacccgtaaactcgcccagaagctaggtgtagagcagcctacattgtattggcatgtaaaaaataagcgagctctgctcgacgcattggccattgagatgctggataggcacgcgactcactattgccctttagaaggggaaagctggcaagattttttacgtaataacgctaaaagtatgagatgtgctttactaagtcatcgcgatggagcaaaagtatgtttaggtacaggctttacagaacagatgtatgaaactgccgaaaatagtatggcctttttatgccaacaaggtttttcactagagcacgcactgtatgcaatgcaggctgctggtatttttactttaggttgcgtattgttggatcaagagcttcaagtcgctaaagaagaaagggaaacacctactactgatagtatgccgccattagtccgacaagctctggaattaaaggatcaccaaggtgcagagccagccttcttattcggccttgaattgatcatatgcggattagaaaaacaacttaaatgtgaaagtgggtcttaa

SEQ ID NO: 708 - DNA, 627 bp, Artificial sequence
  SuR L7-2B02 CDS
atgggatctagattagataaaagtaaagtgattaacagcgcattagagctgcttaatgaggtcggaatcgaaggtttaacaacccgtaaactcgcccagaagctaggtgtagagcagcctacattgtattggcatgtaaaaaataagcgagctctgctcgacgcaatggccattgagatgctggataggcacgcgactcactattgccctttagaaggggaaagctggcaagattttttacgtaataacgctaaaagtatgagatgtgctttactaagtcatcgcgatggagcaaaagtatgtttaggtacaggctttacagaacagatgtatgaaagtgccgaaaatagtctggcctttttatgccaacaaggtttttcactagagaacgcactgtatgcaatgcaggctgttggtatttatactttaggttgcgtattgttggatcaagagcttcaagtcgctaaagaagaaagggaaacacctactactgatagtatgccgccattagtccgacaagttctggaattaaaggatcaccaaggtgcagagccagccttcttattcggccttgaattgatcatatgcggattagaaaaacaacttaaatgtgaaagtgggtcttaa

SEQ ID NO: 709 - DNA, 627 bp, Artificial sequence
  SuR L7-2D02 CDS
atgggatctagattagataaaagtaaagtgattaacagcgcattagagctgcttaatgaggtcggaatcgaaggtttaacaacccgtaaactcgcccagaagctaggtgtagagcagcctacattgtattggcatgtaaaaaataagcgagctctgctcgacgcaatggccattgagatgctggataggcacgcgactcacttctgccctttagaaggggaaagctggcaagattttttacgtaataacgctaaaagtatgagatgtactttactaagtcatcgcgatggagcaaaagtatgtttaggtacaggctttacagaacagcaatatgaaagtgccgaaaatagtctggcctttttatgccaacaaggtttttcactagagaacgcaatgtatgcaatgcaggctgttggtatttatactttaggttgcgtattgttggatcaagagcttcaagtcgctaaagaagaaagggaaacacctactactgatagtatgccgccattagtccgacaagctctggaattaaaggatcaccaaggtgcagagccagccttcttattcggccttgaattgatcatatgcggattagaaaaacaacttaaatgtgaaagtgggtcttaa

SEQ ID NO: 710 - DNA, 627 bp, Artificial sequence
  SuRL7-2E02 CDS
atgggatctagattagataaaagtaaagtgattaacagcgcattagagctgcttaatgaggtcggaatcgaaggtttaacaacccgtaaactcgcccagaagctaggtgtagagcagcctacattgtattggcatgtaaaaaataagcgagctctgctcgacgcattggccattgagatgctggataggcacgcgactcacatctgccctttagaaggggaaagctggcaagattttttacgtaataacgctaaaagtatgagatgtgctttactaagtcatcgcgatggagcaaaagtatgtttaggtacaggctttacagaacagatgtatgaagctgccgaaaatagtatggcctttttatgccaacaaggtttttcactagagaacgcaatgtatgcaatgcaggctgctggtatttatactttaggttgcgtattgttggatcaagagcttcaagtcgctaaagaagaaagggaaacacctactactgatagtatgccgccattagtccgacaagctctggaattaaaggatcaccaaggtgcagagccagccttcttattcggccttgaattgatcatatgcggattagaaaaacaacttaaatgtgaaagtgggtcttaa

SEQ ID NO: 711 - DNA, 627 bp, Artificial sequence
  SuR L7-2F02 CDS
atgggatctagattagataaaagtaaagtgattaacagcgcattagagctgcttaatgaggtcggaatcgaaggtttaacaacccgtaaactcgcccagaagctaggtgtagagcagcctacattgtattggcatgtaaaaaataagcgagctctgctcgacgcaatggccattgagatgctggataggcacgcgactcactattgccctttagaaggggaaagctggcaagattttttacgtaataacgctaaaagtatgagatgtgctttactaagtcatcgcgatggagcaaaagtatgtttaggtacaggctttacagaacagcactatgaaactgccgaaaatagtctggcctttttatgccaacaaggtttttcactagagaacgcaatgtatgcaatgcaggctgctggtatttatactttaggttgcgtattgttggatcaagagcttcaagtcgctaaagaagaaagggaaacacctactactgatagtatgccgccattagtccgacaagttctggaattaaaggatcaccaaggtgcagagccagccttcttattcggccttgaattgatcatatgcggattagaaaaacaacttaaatgtgaaagtgggtcttaa

SEQ ID NO: 712 - DNA, 627 bp, Artificial sequence
  SuR L7-2G02 CDS
atgggatctagattagataaaagtaaagtgattaacagcgcattagagctgcttaatgaggtcggaatcgaaggtttaacaacccgtaaactcgcccagaagctaggtgtagagcagcctacattgtattggcatgtaaaaaataagcgagctctgctcgacgcaatggccattgagatgctggataggcacgcgactcacttgtgccctttagaaggggaaagctggcaagattttttacgtaataacgctaaaagtatgagatgtgctttactaagtcatcgcgatggagcaaaagtatgtttaggtacaggctttacagaacagcaatatgaaactgccgaaaatagtatggcctttttatgccaacaaggtttttcactagagcacgcaatgtatgcaatgcaggctgctggtatttatactttaggttgcgtattgttggatcaagagcttcaagtcgctaaagaagaaagggaaacacctactactgatagtatgccgccattagtccgacaaggtctggaattaaaggatcaccaaggtgcagagccagccttcttattcggccttgaattgatcatatgcggattagaaaaacaacttaaatgtgaaagtgggtcttaa

SEQ ID NO: 713 - DNA, 627 bp, Artificial sequence
  SuR L7-2H02 CDS
atgggatctagattagataaaagtaaagtgattaacagcgcattagagctgcttaatgaggtcggaatcgaaggtttaacaacccgtaaactcgcccagaagctaggtgtagagcagcctacattgtattggcatgtaaaaaataagcgagctctgctcgacgcattggccattgagatgctggataggcacgcgactcacttctgccctttagaaggggaaagctggcaagattttttacgtaataacgctaaaagtatgagatgtgctttactaagtcatcgcgatggagcaaaagtatgtttaggtacaggctttacagaacagatgtatgaagctgccgaaaatagtatggcctttttatgccaacaaggtttttcactagagcacgcaatgtatgcaatgcaggctgtttgtatttatactttaggttgcgtattgttggatcaagagcttcaagtcgctaaagaagaaagggaaacacctactactgatagtatgccgccattagctcgacaaggtctggaattaaaggatcaccaaggtgcagagccagccttcttattcggccttgaattgatcatatgcggattagaaaaacaacttaaatgtgaaagtgggtcttaa

SEQ ID NO: 714 - DNA, 627 bp, Artificial sequence
  SuR L7-2D03 CDS
atgggatctagattagataaaagtaaagtgattaacagcgcattagagctgcttaatgaggtcggaatcgaaggtttaacaacccgtaaactcgcccagaagctaggtgtagagcagcctacattgtattggcatgtaaaaaataagcgagctctgctcgacgcattggccattgagatgctggataggcacgcgactcactattgccctttagaaggggaaagctggcaagattttttacgtaataacgctaaaagtatgagatgtgctttactaagtcatcgcgatggagcaaaagtatgtttaggtacaggctttacagaacagcactatgaaactgccgaaaatagtctggcctttttatgccaacaaggtttttcactagagaacgcaatgtatgcaatgcaggctgttggtatttttactttaggttgcgtattgttggatcaagagcttcaagtcgctaaagaagaaagggaaacacctactactgatagtatgccgccattagtccgacaagttctggaattaaaggatcaccaaggtgcagagccagccttcttattcggccttgaattgatcatatgcggattagaaaaacaacttaaatgtgaaagtgggtcttaa

SEQ ID NO: 715 - DNA, 627 bp, Artificial sequence
  SuR L7-2E03 CDS
atgggatctagattagataaaagtaaagtgattaacagcgcattagagctgcttaatgaggtcggaatcgaaggtttaacaacccgtaaactcgcccagaagctaggtgtagagcagcctacattgtattggcatgtaaaaaataagcgagctctgctcgacgcaatggccattgagatgctggataggcacgcgactcactattgccctttagaaggggaaagctggcaagattttttacgtaataacgctaaaagtatgagatgtgctttactaagtcatcgcgatggagcaaaagtatgtttaggtacaggctttacagaacagcaatatgaaagtgccgaaaatagtctggcctttttatgccaacaaggtttttcactagagaacgcaatgtatgcaatgcaggctgctggtatttatactttaggttgcgtattgttggatcaagagcttcaagtcgctaaagaagaaagggaaacacctactactgatagtatgccgccattagtccgacaagctctggaattaaaggatcaccaaggtgcagagccagccttcttattcggccttgaattgatcatatgcggattagaaaaacaacttaaatgtgaaagtgggtcttaa

SEQ ID NO: 716 - DNA, 627 bp, Artificial sequence
  SuR L7-2F03 CDS
atgggatctagattagataaaagtaaagtgattaacagcgcattagagctgcttaatgaggtcggaatcgaaggtttaacaacccgtaaactcgcccagaagctaggtgtagagcagcctacattgtattggcatgtaaaaaataagcgagctctgctcgacgcaatggccattgagatgctggataggcacgcgactcactattgccctttagaaggggaaagctggcaagattttttacgtaataacgctaaaagtatgagatgtgctttactaagtcatcgcgatggagcaaaagtatgtttaggtacaggctttacagaacagcaatatgaagctgccgaaaatagtctggcctttttatgccaacaaggtttttcactagagaacgcactgtatgcaatgcaggctgttggtatttatactttaggttgcgtattgttggatcaagagcttcaagtcgctaaagaagaaagggaaacacctactactgatagtatgccgccattagctcgacaagctctggaattaaaggatcaccaaggtgcagagccagccttcttattcggccttgaattgatcatatgcggattagaaaaacaacttaaatgtgaaagtgggtcttaa

SEQ ID NO: 717 - DNA, 627 bp, Artificial sequence
  SuR L7-2G03 CDS
atgggatctagattagataaaagtaaagtgattaacagcgcattagagctgcttaatgaggtcggaatcgaaggtttaacaacccgtaaactcgcccagaagctaggtgtagagcagcctacattgtattggcatgtaaaaaataagcgagctctgctcgacgcaatggccattgagatgctggataggcacgcgactcacttctgccctttagaaggggaaagctggcaagattttttacgtaataacgctaaaagtatgagatgtgctttactaagtcatcgcgatggagcaaaagtatgtttaggtacaggctttacagaacagcaatatgaagctgccgaaaatagtatggcctttttatgccaacaaggtttttcactagagcacgcactgtatgcaatgcaggctgttggtatttttactttaggttgcgtattgttggatcaagagcttcaagtcgctaaagaagaaagggaaacacctactactgatagtatgccgccattagtccgacaaggtctggaattaaaggatcaccaaggtgcagagccagccttcttattcggacttgaattgatcatatgcggattagaaaaacaacttaaatgtgaaagtgggtcttaa

SEQ ID NO: 718 - DNA, 627 bp, Artificial sequence
  SuR L7-2H03 CDS
atgggatctagattagataaaagtaaagtgattaacagcgcattagagctgcttaatgaggtcggaatcgaaggtttaacaacccgtaaactcgcccagaagctaggtgtagagcagcctacattgtattggcatgtaaaaaataagcgagctctgctcgacgcattggccattgagatgctggataggcacgcgactcactattgccctttagaaggggaaagctggcaagattttttacgtaataacgctaaaagtatgagatgtgctttactaagtcatcgcgatggagcaaaagtatgtttaggtacaggctttacagaacagatgtatgaaactgccgaaaatagtatggcctttttatgccaacaaggtttttcactagagaacgcaatgtatgcaatgcaggctgttggtatttttactttaggttgcgtattgttggatcaagagcttcaagtcgctaaagaagaaagggaaacacctactactgatagtatgccgccattagtccgacaagttctggaattaaaggatcaccaaggtgcagagccagccttcttattcggccttgaattgatcatatgcggattagaaaaacaacttaaatgtgaaagtgggtcttaa

SEQ ID NO: 719 - DNA, 627 bp, Artificial sequence
  SuR L7-2D04 CDS
atgggatctagattagataaaagtaaagtgattaacagcgcattagagctgcttaatgaggtcggaatcgaaggtttaacaacccgtaaactcgcccagaagctaggtgtagagcagcctacattgtattggcatgtaaaaaataagcgagctctgctcgacgcattggccattgagatgctggataggcacgcgactcactattgccctttagaaggggaaagctggcaagattttttacgtaataacgctaaaagtatgagatgtgctttactaagtcatcgcgatggagcaaaagtatgtttaggtacaggctttacagaaaagcaatatgaaagtgccgaaaatagtctggcctttttatgccaacaaggtttttcactagagcacgcactgtatgcaatgcaggctgttggtatttatactttaggttgcgtattgttggatcaagagcttcaagtcgctaaagaagaaagggaaacacctactaatgatagtatgccgccattagtccgacaagttctggaattaaaggatcaccaaggtgcagagccagccttcttattcggccttgaattgatcatatgcggattagaaaaacaacttaaatgtgaaagtgggtcttaa

SEQ ID NO: 720 - DNA, 627 bp, Artificial sequence
  SuR L7-2E04 CDS
atgggatctagattagataaaagtaaagtgattaacagcgcattagagctgcttaatgaggtcggaatcgaaggtttaacaacccgtaaactcgcccagaagctaggtgtagagcagcctacattgtattggcatgtaaaaaataagcgagctctgctcgacgcaatggccattgagatgctggataggcacgcgactcactattgccctttagaaggggaaagctggcaagattttttacgtaataacgctaaaagtatgagatgtgctttactaagtcatcgcgatggagcaaaagtatgtttaggtacaggctttacagaacagcaatatgaaactgccgaaaatagtatggcctttttatgccaacaaggtttttcactagagaacgcaatgtatgcaatgcaggctgcttgtatttatactttaggttgcgtattgttggatcaagagcttcaagtcgctaaagaagaaagggaaacacctactactgatagtatgccgccattagtccgacaagttctggaattaaaggatcaccaaggtgcagagccagccttcttattcggccttgaattgatcatatgcggattagaaaaacaacttaaatgtgaaagtgggtcttaa

SEQ ID NO: 721 - DNA, 627 bp, Artificial sequence
  SuR L7-2F04 CDS
atgggatctagattagataaaagtaaagtgattaacagcgcattagagctgcttaatgaggtcggaatcgaaggtttaacaacccgtaaactcgcccagaagctaggtgtagagcagcctacattgtattggcatgtaaaaaataagcgagctctgctcgacgcattggccattgagatgctggataggcacgcgactcactattgccctttagaaggggaaagctggcaagattttttacgtaataacgctaaaagtatgagatgtgctttactaagtcatcgcgatggagcaaaagtatgtttaggtacaggctttacagaacagatgtatgaaactgccgaaaatagtatggcctttttatgccaacaaggtttttcactagagcacgcaatgtatgcaatgcaggctgttggtatttttactttaggttgcgtattgttggatcaagagcttcaagtcgctaaagaagaaagggaaacacctactactgatagtatgccgccattagtccgacaagctctggaattaaaggatcaccaaggtgcagagccagccttcttattcggccttgaattgatcatatgcggattagaaaaacaacttaaatgtgaaagtgggtcttaa

SEQ ID NO: 722 - DNA, 627 bp, Artificial sequence
  SuR L7-2H04 CDS
atgggatctagattagataaaagtaaagtgattaacagcgcattagagctgcttaatgaggtcggaatcgaaggtttaacaacccgtaaactcgcccagaagctaggtgtagagcagcctacattgtattggcatgtaaaaaataagcgagctctgctcgacgcaatggccattgagatgctggataggcacgcgactcacatctgccctttagaagaggaaagctggcaagattttttacgtaataacgctaaaagtatgagatgtgctttactaagtcatcgcgatggagcaaaagtatgtttaggtacaggctttacagaacagcaatatgaaactgccgaaaatagtatggcctttttatgtcaacaaggtttttcactagagcacgcaatgtatgcaatgcaggctgcttgtatttatactttaggttgcgtattgttggatcaagagcttcaagtcgctaaagaagaaagggaaacacctactactgatagtatgccgccattagtccgacaagttctggaattaaaggatcaccaaggtgcagagccagccttcttattcggccttgaattgatcatatgcggattagaaaaacaacttaaatgtgaaagtgggtcttaa

SEQ ID NO: 723 - DNA, 627 bp, Artificial sequence
  SuR L7-2B05 CDS
atgggatctagattagataaaagtaaagtgattaacagcgcattagagctgcttaatgaggtcggaatcgaaggtttaacaacccgtaaactcgcccagaagctaggtgtagagcagcctacattgtattggcatgtaaaaaataagcgagctctgctcgacgcaatggccattgagatgctggataggcacgcgactcactattgccctttagaaggggaaagctggcaagattttttacgtaataacgctaaaagtatgagatgtgctttactaagtcatcgcgatggagcaaaagtatgtttaggtacaggctttacagaacagcactatgaaactgccgaaaatagtatggcctttttatgccaacaaggtttttcactagagcacgcaatgtatgcaatgcaggctgctggtatttatactttaggttgcgtattgttggatcaagagcttcaagtcgctaaagaagaaagggaaacacctactactgatagtatgccgccattagtccgacaagctctggaattaaaggatcaccaaggtgcagagccagccttcttattcggccttgaattgatcatatgcggattagaaaaacaacttaaatgtgaaagtgggtcttaa

SEQ ID NO: 724 - DNA, 627 bp, Artificial sequence
  SuR L7-2D05 CDS
atgggatctagattagataaaagtaaagtgattaacagcgcattagagctgcttaatgaggtcggaatcgaaggtttaacaacccgtaaactcgcccagaagctaggtgtagagcagcctacattgtattggcatgtaaaaaataagcgagctctgctcgacgcaatggccattgagatgctggataggcacgcgactcactattgccctttagaaggggaaagctggcaagattttttacgtaataacgctagaagtatgagatgtgctttactaagtcatcgcgatggagcaaaagtatgtttaggtacaggctttacagaacagatgtatgaaactgccgaaaatagtctggcctttttatgccaacaaggtttttcactagagaacgcaatgtatgcaatgcaggctgctggtatttatactttaggttgcgtattgttggatcaagagcttcaagtcgctaaagaagaaagggaaacacctactactgatagtatgccgccattagtccgacaagttctggaattaaaggatcaccaaggtgcagagccagccttcttattcggccttgaattgatcatatgcggattagaaaaacaacttaaatgtgaaagtgggtcttaa

SEQ ID NO: 725 - DNA, 627 bp, Artificial sequence
  SuR L7-2E05 CDS
atgggatctagattagataaaagtaaagtgattaacagcgcattagagctgcttaatgaggtcggaatcgaaggtttaacaacccgtaaactcgcccagaagctaggtgtagagcagcctacattgtattggcatgtaaaaaataagcgagctctgctcgacgcaatggccattgagatgctggataggcacgcgactcactattgccctttagaaggggaaagctggcaagattttttacgtaataacgctaaaagtatgagatgtgctttactaagtcatcgcgatggagcaaaagtatgtttaggtacaggctttacagaacagcaatatgaaagtgccgaaaatagtctggcctttttatgccaacaaggtttttcactagagaacgcactgtatgcaatgcaggctgttggtatttatactttaggttgcgtattgttggatcaagagcttcaagtcgctaaagaagaaagggaaacacctactactgatagtatgccgccattactccgacaagctctggaattaaaggatcaccaaggtgcagagccagccttcttattcggccttgaattgatcatatgcggattagaaaaacaacttaaatgtgaaagtgggtcttaa

SEQ ID NO: 726 - DNA, 627 bp, Artificial sequence
  SuR L7-2F05 CDS
atgggatctagattagataaaagtaaagtgattaacagcgcattagagctgcttaatgaggtcggaatcgaaggtttaacaacccgtaaactcgcccagaagctaggtgtagagcagcctacattgtattggcatgtaaaaaataagcgagctctgctcgacgcattggccattgagatgctggataggcacgcgactcactattgccctttagaaggggaaagctggcaagattttttacgtaataacgctaaaagtatgagatgtgctttactaagtcatcgcgatggagcaaaagtatgtttaggtacaggctttacagaaaagcaatatgaaagtgccgaaaatagtatggcctttttatgccaacaaggtttttcactagagcacgcactgtatgcaatgcaggctgttggtatttttactttaggttgcgtattgttggatcaagagcttcaagtcgctaaagaagaaagggaaacacctactactgatagtatgccgccattagtccgacaagttctggaattaaaggatcaccaaggtgcagagccagccttcttattcggccttgaattgatcatatgcggattagaaaaacaacttaaatgtgaaagtgggtcttaa

SEQ ID NO: 727 - DNA, 627 bp, Artificial sequence
  SuR L7-2H05 CDS
atgggatctagattagataaaagtaaagtgattaacagcgcattagagctgcttaatgaggtcggaatcgaaggtttaacaacccgtaaactcgcccagaagctaggtgtagagcagcctacattgtattggcatgtaaaaaataagcgagctctgctcgacgcaatggccattgagatgctggataggcacgcgactcactattgccctttagaaggggaaagctggcaagattttttacgtaataacgctaaaagtatgagatgtgctttactaagtcatcgcgatggagcaaaagtatgtttaggtacaggctttacagaacagcaatatgaaagtgccgaaaatagtatggcctttttatgccaacaaggtttttcactagagcacgcactgtatgcaatgcaggctgctggtatttatactttaggttgcgtattgttgaatcaagagcttcaagtcgctaaagaagaaagggaaacacctactactgatagtatgccgccattagtccgacaaggtctggaattaaaggatcaccaaggtgcagagccagccttcttattcggccttgaattgatcatatgcggattagaaaaacaacttaaatgtgaaagtgggtcttaa

SEQ ID NO: 728 - DNA, 627 bp, Artificial sequence
  SuR L7-2A06 CDS
atgggatctagattagataaaagtaaagtgattaacagcgcattagagctgcttaatgaggtcggaatcgaaggtttaacaacccgtaaactcgcccagaagctaggtgtagagcagcctacattgtattggcatgtaaaaaataagcgagctctgctcgacgcaatggccattgagatgctggatagtcacgcgactcactattgccctttagaaggggaaagctggcaagattttttacgtaataacgctaaaagtatgagatgtgctttactaagtcatcgcgatggagcaaaagtatgtttaggtacaggctttacagaacagcaatatgaaactgccgaaaatagtatggcctttttatgccaacaaggtttttcactagagcacgcaatgtatgcaatgcaggctgctggtatttttactttaggttgcgtattgttggatcaagagcttcaagtcgctaaagaagaaagggaaacacctactactgatagtatgccgccattagtccgacaaggtctggaattaaaggatcaccaaggtgcagagccagccttcttattcggccttgaattgatcatatgcggattagaaaaacaacttaaatgtgaaagtgggtcttaa

SEQ ID NO: 729 - DNA, 627 bp, Artificial sequence
  SuR L7-2C06 CDS
atgggatctagattagataaaagtaaagtgattaacagcgcattagagctgcttaatgaggtcggaatcgaaggtttaacaacccgtaaactcgcccagaagctaggtgtagagcagcctacattgtattggcatgtaaaaaataagcgagctctgctcgacgcaatggccattgagatgctggataggcacgcgactcactattgccctttagaaggggaaagctggccagattttttacgtaataacgctaaaagtatgagatgtgctttactaagtcatcgcgatggagcaaaagtatgtttaggtacaggctttacagaacagcaatatgaaactgccgaaaatagtctggcctttttatgccaacaaggtttttcactagagcacgcactgtatgcaatgcaggctgttggtatttatactttaggttgcgtattgttggatcaagagcttcaagtcgctaaagaagaaagggaaacacctactactgatagtatgccgccattactccgacaaggtctggaattaaaggatcaccaaggtgcagagccagccttcttattcggccttgaattgatcatatgcggattagaaaaacaacttaaatgtgaaagtgggtcttaa

SEQ ID NO: 730 - DNA, 627 bp, Artificial sequence
  SuR L7-2D06 CDS
atgggatctagattagataaaagtaaagtgattaacagcgcattagagctgcttaatgaggtcggaatcgaaggtttaacaacccgtaaactcgcccagaagctaggtgtagagcagcctacattgtattggcatgtaaaaaataagcgagctctgctcgacgcaatggccattgagatgctggataggcacgcgactcactattgccctttagaaggggaaagctggcaagattttttacgtaataacgctaaaagtatgagatgtgctttactaagtcatcgcgatggagcaaaagtatgtttaggtacaggctttacagaacagcaatatgaaagtgccgaaaatagtctggcctttttatgccaacaaggtttttcactagagaacgcactgtatgcaatgcaggctgttggtatttttactttaggttgcgtattgttggatcaagagcttcaagtcgctaaagaagaaagggaaacacctactactgatagtatgccgccattagtccgacaagctctggaattaaaggatcaccaaggtgcagagccagccttcttattcggccttgaattgatcatatgcggattagaaaaacaacttaaatgtgaaagtgggtcttaa

SEQ ID NO: 731 - DNA, 627 bp, Artificial sequence
  SuR L7-2F06 CDS
atgggatctagattagataaaagtaaagtgattaacagcgcattagagctgcttaatgaggtcggaatcgaaggtttaacaacccgtaaactcgcccagaagctaggtgtagagcagcctacattgtattggcatgtaaaaaataagcgagctctgctcgacgcattggccattgagatgctggataggcacgcgactcactattgccctttagaaggggaaagctggcaagattttttacgtaataacgctaaaagtatgagatgtgctttactaagtcatcgcgatggagcaaaagtatgtttaggtacaggctttacagaaaagcaatatgaaactgccgaaaatagtctggcctttttatgccaacaaggtttttcactagagcacgcactgtatgcaatgcaggctgttggtatttatactttaggttgcgtattgttggatcaagagcttcaagtcgctaaagaagaaagggaaacacctactactgatagtatgccgccattagtccgacaaggtctggaattaaaggatcaccaaggtgcagagccagccttcttattcggccttgaattgatcatatgcggattagaaaaacaacttaaatgtgaaagtgggtcttaa

SEQ ID NO: 732 - DNA, 627 bp, Artificial sequence
  SuR L7-2G06 CDS
atgggatctagattagataaaagtaaagtgattaacagcgcattagagctgcttaatgaggtcggaatcgaaggtttaacaacccgtaaactcgcccagaagctaggtgtagagcagcctacattgtattggcatgtaaaaaataagcgagctctgctcgacgcaatggccattgagatgctggataggcacgcgactcactattgccctttagaaggggaaagctggcaagattttttacgtaataacgctaaaagtatgagatgtgctttactaagtcatcgcgatggagcaaaagtatgtttaggtacaggctttacagaacagcaatatgaaactgccgaaaatagtatggcctttttatgccaacaaggtttttcactagagcacgcactgtatgcaatgcaggctgttggtatttatactttaggttgcgtattgttggatcaagagcttcaagtcgctaaagaagaaagggaaacacctactactgatagtatgccgccattagtccgacaaggtctggaattaaaggatcaccaaggtgcagagccagccttcttattcggccttgaattgatcatatgcggattagaaaaacaacttaaatgtgaaagtgggtcttaa

SEQ ID NO: 733 - DNA, 627 bp, Artificial sequence
  SuR L7-2A07 CDS
  misc_feature (328)..(328): n is a, c, g, or t
  misc_feature (422)..(422): n is a, c, g, or t
  misc_feature (521)..(521): n is a, c, g, or t
atgggatctagattagataaaagtaaagtgattaacagcgcattagagctgcttaatgaggtcggaatcgaaggtttaacaacccgtaaactcgcccagaagctaggtgtagagcagcctacattgtattggcatgtaaaaaataagcgagctctgctcgacgcaatggccattgagatgctggataggcacgcgactcactattgccctttagaaggggaaagctggcaagattttttacgtaataacgctaaaagtatgagatgtgctttactaagtcatcgcgatggagcaaaagtatgtttaggtacaggctttacagaacagntgtatgaagctgccgaaaatagtctggcctttttatgccaacaaggtttttcactagagcacgcactgtatgcaatgcaggctgttggtatttntactttaggttgcgtattgttggatcaagagcttcaagtcgctaaagaagaaagggaaacacctactactgatagtatgccgccattagtccgacaagntctggaattaaaggatcaccaaggtgcagagccagccttcttattcggccttgaattgatcatatgcggattagaaaaacaacttaaatgtgaaagtgggtcttaa

SEQ ID NO: 734 - DNA, 627 bp, Artificial sequence
  SuR L7-2B07 CDS
atgggatctagattagataaaagtaaagtgattaacagcgcattagagctgcttaatgaggtcggaatcgaaggtttaacaacccgtaaactcgcccagaagctaggtgtagagcagcctacattgtattggcatgtaaaaaataagcgagctctgctcgacgcattggccattgagatgctggataggcacgcgactcactattgccctttagaaggggaaagctggcaagattttttacgtaataacgctaaaagtatgagatgtgctttactaagtcatcgcgatggagcaaaagtatgtttaggtacaggctttacagaacagcactatgaaactgccgaaaatagtatggcctttttatgccaacaaggtttttcactagagcacgcaatgtatgcaatgcaggctgctggtatttttactttaggttgcgtattgttggatcaagagcttcaagtcgctaaagaagaaagggaaacacctactactgatagtatgccgccattagtccgacaaggtctggaattaaaggatcaccaaggtgcagagccagccttcttattcggccttgaattgatcatatgcggattagaaaaacaacttaaatgtgaaagtgggtcttaa

SEQ ID NO: 735 - DNA, 627 bp, Artificial sequence
  SuR L7-2C07 CDS
atgggatctagattagataaaagtaaagtgattaacagcgcattagagctgcttaatgaggtcggaatcgaaggtttaacaacccgtaaactcgcccagaagctaggtgtagagcagcctacattgtattggcatgtaaaaaataagcgagctctgctcgacgcaatggccattgagatgctggataggcacgcgactcactattgccctttagaaggggaaagctggcaagattttttacgtaataacgctaaaagtatgagatgtgctttactaagtcatcgcgatggagcaaaagtatgtttaggtacaggctttacagaacagcaatatgaaactgccgaaaatagtctggcctttttatgccaacaaggtttttcactagagcacgcaatgtatgcaatgcaggctgttggtatttttactttaggttgcgtattgttggatcaagagcttcaagtcgctaaagaagaaagggaaacacctactactgatagtatgccgccattagtccgacaaggtctggaattaaaggatcaccaaggtgcagagccagccttcttattcggccttgaattgatcatatgcggattagaaaaacaacttaaatgtgaaagtgggtcttaa

SEQ ID NO: 736 - DNA, 627 bp, Artificial sequence
  SuRL7-2D07 CDS
atgggatctagattagataaaagtaaagtgattaacagcgcattagagctgcttaatgaggtcggaatcgaaggtttaacaacccgtaaactcgcccagaagctaggtgtagagcagcctacattgtattggcatgtaaaaaataagcgagctctgctcgacgcattggccattgagatgctggataggcacgcgactcactattgccctttagaaggggaaagctggcaagattttttacgtaataacgctaaaagtatgagatgtgctttactaagtcatcgcgatggagcaaaagtatgtttaggtacaggctttacagaaaagcaatatgaaactgccgaaaatagtctggcctttttatgccaacaaggtttttcactagagaacgcactgtatgcaatgcaggctgctggtatttatactttaggttgcgtattgttggatcaagagcttcaagtcgctaaagaagaaagggaaacacctactactgatagtatgccgccattagtccgacaagttctggaattaaaggatcaccaaggtgcagagccagccttcttattcggccttgaattgatcatatgcggattagaaaaacaacttaaatgtgaaagtgggtcttaa

SEQ ID NO: 737 - DNA, 627 bp, Artificial sequence
  SuR L7-2E07 CDS
atgggatctagattagataaaagtaaagtgattaacagcgcattagagctgcttaatgaggtcggaatcgaaggtttaacaacccgtaaactcgcccagaagctaggtgtagagcagcctacattgtattggcatgtaaaaaataagcgagctctgctcgacgcattggccattgagatgctggataggcacgcgactcactattgccctttagaaggggaaagctggcaagattttttacgtaataacgctaaaagtatgagatgtgctttactaagtcatcgcgatggagcaaaagtatgtttaggtacaggctttacagaacagcaatatgaagctgccgaaaatagtatggcctttttatgccaacaaggtttttcactagagcacgcaatgtatgcaatgcaggctgctggtatttatactttaggttgcgtattgttggatcaagagcttcaagtcgctaaagaagaaagggaaacacctactactgatagtatgccgccattactccgacaagctctggaattaaaggatcaccaaggtgcagagccagccttcttattcggccttgaattgatcatatgcggattagaaaaacaacttaaatgtgaaagtgggtcttaa

SEQ ID NO: 738 - DNA, 627 bp, Artificial sequence; identical to SEQ ID NO: 727
  SuR L7-2G07 CDS

SEQ ID NO: 739 - DNA, 627 bp, Artificial sequence
  SuR L7-2B08 CDS
  misc_feature (203)..(204): n is a, c, g, or t
  misc_feature (337)..(337): n is a, c, g, or t
atgggatctagattagataaaagtaaagtgattaacagcgcattagagctgcttaatgaggtcggaatcgaaggtttaacaacccgtaaactcgcccagaagctaggtgtagagcagcctacattgtattggcatgtaaaaaataagcgagctctgctcgacgcaatggccattgagatgctggataggcacgcgactcactnntgccctttagaaggggaaagctggcaagattttttacgtaataacgctaaaagtatgagatgtgctttactaagtcatcgcgatggagcaaaagtatgtttaggtacaggctttacagaacagatgtatgaangtgccgaaaatagtatggcctttttatgccaacaaggtttttcactagagmacgcaatgtatgcaatgcaggctgttggtatttttactttaggttgcgtattgttggatcaagagcttcaagtcgctaaagaagaaagggaaacacctactactgatagtatgccgccattagyccgacaagttctggaattaaaggatcaccaaggtgcagagccagccttcttattcggccttgaattgatcatatgcggattagaaaaacaacttaaatgtgaaagtgggtcttaa

SEQ ID NO: 740 - DNA, 627 bp, Artificial sequence
  SuR L7-2D08 CDS
atgggatctagattagataaaagtaaagtgattaacagcgcattagagctgcttaatgaggtcggaatcgaaggtttaacaacccgtaaactcgcccagaagctaggtgtagagcagcctacattgtattggcatgtaaaaaataagcgagctctgctcgacgcaatggccattgagatgctggataggcacgcgactcactattgccctttagaaggggaaagctggcaagattttttacgtaataacgctaaaagtatgagatgtgctttactaagtcatcgcgatggagcaaaagtatgtttaggtacaggctttacagaacagcaatatgaaactgccgaaaatagtctggcctttttatgccaacaaggtttttcactagagcacgcactgtatgcaatgcaggctgttggtatttatactttaggttgcgtattgttggatcaagagcttcaagtcgctaaagaagaaagggaaacacctactactgatagtatgccgccattagtccgacaagctctggaattaaaggatcaccaaggtgcagagccagccttcttattcggccttgaattgatcatatgcggattagaaaaacaacttaaatgtgaaagtgggtcttaa

SEQ ID NO: 741 - DNA, 627 bp, Artificial sequence
  SuR L7-2F08 CDS
atgggatctagattagataaaagtaaagtgattaacagcgcattagagctgcttaatgaggtcggaatcgaaggtttaacaacccgtaaactcgcccagaagctaggtgtagagcagcctacattgtattggcatgtaaaaaataagcgagctctgctcgacgcaatggccattgagatgctggataggcacgcgactcactattgccctttagaaggggaaagctggcaagattttttacgtaataacgctaaaagtatgagatgtgctttactaagtcatcgcgatggagcaaaagtatgtttaggtacaggctttacagaacagcaatatgaaactgccgaaaatagtatggcctttttatgccaacaaggtttttcactagagcacgcaatgtatgcaatgcaggctgcttgtatttttactttaggttgcgtattgttggatcaagagcttcaagtcgctaaagaagaaagggaaacacctactactgatagtatgccgccattagtccgacaagttctggaattaaaggatcaccaaggtgcagagccagccttcttattcggccttgaattgatcatatgcggattagaaaaacaacttaaatgtgaaagtgggtcttaa

SEQ ID NO: 742 - DNA, 627 bp, Artificial sequence
  SuR L7-2G08 CDS
atgggatctagattagataaaagtaaagtgattaacagcgcattagagctgcttaatgaggtcggaatcgaaggtttaacaacccgtaaactcgcccagaagctaggtgtagagcagcctacattgtattggcatgtaaaaaataagcgagctctgctcgacgcattggccattgagatgctggataggcacgcgactcactattgccctttagaaggggaaagctggcaagattttttacgtaataacgctaaaagtatgagatgtgctttactaagtcatcgcgatggagcaaaagtatgtttaggtacaggctttacagaacagatgtatgaaactgccgaaaatagtctggcctttttatgccaacaaggtttttcactagagcacgcactgtatgcaatgcaggctgttggtatttttactttaggttgcgtattgttggatcaagagcttcaagtcgctaaagaagaaagggaaacacctactactgatagtatgccgccattagtccgacaaggtctggaattaaaggatcaccaaggtgcagagccagccttcttattcggccttgaattgatcatatgcggattagaaaaacaacttaaatgtgaaagtgggtcttaa

SEQ ID NO: 743 - DNA, 627 bp, Artificial sequence
  SuR L7-2B09 CDS
atgggatctagattagataaaagtaaagtgattaacagcgcattagagctgcttaatgaggtcggaatcgaaggtttaacaacccgtaaactcgcccagaagctaggtgtagagcagcctacattgtattggcatgtaaaaaataagcgagctctgctcgacgcaatggccattgagatgctggataggcacgcgactcacatgtgccctttagaaggggaaagctggcaagattttttacgtaataacgctaaaagtatgagatgtgctttactaagtcatcgcgatggagcaaaagtatgtttaggtacaggctttacagaacagatgtatgaaagtgccgaaaatagtatggcctttttatgccaacaaggtttttcactagagaacgcaatgtatgcaatgcaggctgttggtatttttactttaggttgcgtattgttggatcaagagcttcaagtcgctaaagaagaaagggaaacacctactactgatagtatgccgccattagctcgacaagttctggaattaaaggatcaccaaggtgcagagccagccttcttattcggccttgaattgatcatatgcggattagaaaaacaacttaaatgtgaaagtgggtcttaa

SEQ ID NO: 744 - DNA, 627 bp, Artificial sequence
  SuR L7-2C09 CDS
atgggatctagattagataaaagtaaagtgattaacagcgcattagagctgcttaatgaggtcggaatcgaaggtttaacaacccgtaaactcgcccagaagctaggtgtagagcagcctacattgtattggcatgtaaaaaataagcgagctctgctcgacgcaatggccattgagatgctggataggcacgcgactcacatgtgccctttagaaggggaaagctggcaagattttttacgtaataacgctaaaagtatgagatgtgctttactaagtcatcgcgatggagcaaaagtatgtttaggtacaggctttacagaacagatgtatgaaactgccgaaaatagtatggcctttttatgccaacaaggtttttcactagagaacgcaatgtatgcaatgcaggctgctggtatttatactttaggttgcgtattgttggatcaagagcttcaagtcgctaaagaagaaagggaaacacctactactgatagtatgccgccattagtccgacaagttctggaattaaaggatcaccaaggtgcagagccagccttcttattcggccttgaattgatcatatgcggattagaaaaacaacttaaatgtgaaagtgggtcttaa

SEQ ID NO: 745 - DNA, 627 bp, Artificial sequence
  SuR L7-2E09 CDS
atgggatctagattagataaaagtaaagtgattaacagcgcattagagctgcttaatgaggtcggaatcgaaggtttaacaacccgtaaactcgcccagaagctaggtgtagagcagcctacattgtattggcatgtaaaaaataagcgagctctgctcgacgcattggccattgagatgctggataggcacgcgactcactattgccctttagaaggggaaagctggcaagattttttacgtaataacgctaaaagtatgagatgtgctttactaagtcatcgcgatggagcaaaagtatgtttaggtacaggctttacagaacagatgtatgaaagtgccgaaaatagtctggcctttttatgccaacaaggtttttcactagagaacgcaatgtatgcaatgcaggctgctggtatttttactttaggttgcgtattgttggatcaagagcttcaagtcgctaaagaagaaagggaaacacctactactgatagtatgccgccattagtccgacaagttctggaattaaaggatcaccaaggtgcagagccagccttcttattcggccttgaattgatcatatgcggattagaaaaacaacttaaatgtgaaagtgggtcttaa

SEQ ID NO: 746 - DNA, 627 bp, Artificial sequence
  SuR L7-2B10 CDS
atgggatctagattagataaaagtaaagtgattaacagcgcattagagctgcttaatgaggtcggaatcgaaggtttaacaacccgtaaactcgcccagaagctaggtgtagagcagcctacattgtattggcatgtaaaaaataagcgagctctgctcgacgcaatggccattgagatgctggataggcacgcgactcacttctgccctttagaaggggaaagctggcaagattttttacgtaataacgctaaaagtatgagatgtgctttactaagtcatcgcgatggagcaaaagtatgtttaggtacaggctttacagaacagcaatatgaaggtgccgaaaatagtatggcctttttatgccaacaaggtttttcactagagaacgcaatgtatgcaatgcaggctgctggtatttttactttaggttgcgtattgttggatcaagagcttcaagtcgctaaagaagaaagggaaacacctactactgatagtatgccgccattagtccgacaagttctggaattaaaggatcaccaaggtgcagagccagccttcttattcggccttgaattgatcatatgcggattagaaaaacaacttaaatgtgaaagtgggtcttaa

SEQ ID NO: 747 - DNA, 627 bp, Artificial sequence
  SuR L7-2E10 CDS
  misc_feature (244)..(244): n is a, c, g, or t
  misc_feature (521)..(521): n is a, c, g, or t
atgggatctagattagmyaaaagtaaagtgattaacagcgcattagagctgcttaatgaggtcggaatcgaaggtttaacaacccgtaaactcgcccagaagctaggtgtagagcagcctacattgtattggcatgtaaaaaataagcgagctctgctcgacgcattggccattgagatgctggataggcacgcgactcactattgccctttagaaggggaaagctggcaagattttttacgtnataacgctaaaagtatgagatgtgctttactaagtcatcgcgatggagcaaaagtatgtttaggtacaggctttacagaacagmtgtatgaaactgccgaaaatagtctggcctttttatgccaacaaggtttttcactagagmacgcactgtatgcaatgcaggctgttggtatttatactttaggttgcgtattgttggatcaagagcttcaagtcgctaaagaagaaagggaaacacctactactgatagtatgccgccattactccgacaagntctggaattaaaggatcaccaaggtgcagagccagccttcttattcggccttgaattgatcatatgcggattagaaaaacaacttaaatgtgaaagtgggtcttaa

SEQ ID NO: 748 - DNA, 627 bp, Artificial sequence
  SuR L7-2G10 CDS
  misc_feature (573)..(573): n is a, c, g, or t
atgggatctagattagataaaagtaaagtgattaacagcgcattagagctgcttaatgaggtcggaatcgaaggtttaacaacccgtaaactcgcccagaagctaggtgtagagcagcctacattgtattggcatgtaaaaaataagcgagctctgctcgacgcaatggccattgagatgctggataggcacgcgactcactattgccctttagaaggggaaagctggcaagattttttacgtaataacgctaaaagtatgagatgtgctttactaagtcatcgcgatggagcaaaagtatgtttaggtacaggctttacagaacagcaatatgaaactgccgaaaatagtatggcctttttatgccaacaaggtttttcactagagcacgcactgtatgcaatgcaggctgctggtatttatactttaggttgcgtattgttggatcaagagcttcaagtcgctaaagaagaaagggaaacacctactactgatagtatgccgccattactccgacaaggtctggaattaaaggatcaccaaggtgcagagccagccttcttattcggcctngaattgatcatatgcggattagaaaaacaacttaaatgtgaaagtgggtcttaa

SEQ ID NO: 749 - DNA, 627 bp, Artificial sequence
  SuR L7-2C11 CDS
atgggatctagattagataaaagtaaagtgattaacagcgcattagagctgcttaatgaggtcggaatcgaaggtttaacaacccgtaaactcgcccagaagctaggtgtagagcagcctacattgtattggcatgtaaaaaataagcgagctctgctcgacgcaatggccattgagatgctggataggcacgcgactcactattgccctttagaaggggaaagctggcaagattttttacgtaataacgctaaaagtatgagatgtgctttactaagtcatcgcgatggagcaaaagtatgtttaggtacaggctttacagaacagcaatatgaaactgccgaaaatagtatggcctttttatgccaacaaggtttttcactagagaacgcaatgtatgcaatgcaggctgctggtatttttactttaggttgcgtattgttggatcaagagcttcaagtcgctaaagaagaaagggaaacacctactactgatagtatgccgccattagtccgacaagttctggaattaaaggatcaccaaggtgcagagccagccttcttattcggccttgaattgatcatatgcggattagaaaaacaacttaaatgtgaaagtgggtcttaa

SEQ ID NO: 750 - DNA, 627 bp, Artificial sequence
  SuR L7-2D11 CDS
atgggatctagattagataaaagtaaagtgattaacagcgcattagagctgcttaatgaggtcggaatcgaaggtttaacaacccgtaaactcgcccagaagctaggtgtagagcagcctacattgtattggcatgtaaaaaataagcgagctctgctcgacgcaatggccattgagatgctggataggcacgcgactcactattgccctttagaaggggaaagctggcaagattttttacgtaataacgctagaagtatgagatgtgctttactaagtcatcgcgatggagcaaaagtatgtttaggtacaggctttacagaacagatgtatgaaactgccgaaaatagtctggcctttttatgccaacaaggtttttcactagagaacgcactgtatgcaatgcaggctgctggtatttatactttaggttgcgtattgttggatcaagagcttcaagtcgctaaagaagaaagggaaacacctactactgatagtatgccgccattagtccgacaagttctggaattaaaggatcaccaaggtgcagagccagccttcttattcggccttgaattgatcatatgcggattagaaaaacaacttaaatgtgaaagtgggtcttaa

SEQ ID NO: 751 - DNA, 627 bp, Artificial sequence
  SuR L7-2F11 CDS
atgggatctagattagataaaagtaaagtgattaacagcgcattagagctgcttaatgaggtcggaatcgaaggtttaacaacccgtaaactcgcccagaagctaggtgtagagcagcctacattgtattggcatgtaaaaaataagcgagctctgctcgacgcattggccattgagatgctggataggcacgcgactcactattgccctttagaaggggaaagctggcaagattttttacgtaataacgctaaaagtatgagatgtgctttactaagtcatcgcgatggagcaaaagtatgtttaggtacaggctttacagaacagatgtatgaaactgccgaaaatagtctggcctttttatgccaacaaggtttttcactagagaacgcactgtatgcaatgcaggctgctggtatttttactttaggttgcgtattgttggatcaagagcttcaagtcgctaaagaagaaagggaaacacctactactgatagtatgccgccattagtccgacaagctctggaattaaaggatcaccaaggtgcagagccagccttcttattcggccttgaattgatcatatgcggattagaaaaacaacttaaatgtgaaagtgggtcttaa

SEQ ID NO: 752 - DNA, 627 bp, Artificial sequence
  SuR L7-2G11 CDS
atgggatctagattagataaaagtaaagtgattaacagcgcattagagctgcttaatgaggtcggaatcgaaggtttaacaacccgtaaactcgcccagaagctaggtgtagagcagcctacattgtattggcatgtaaaaaataagcgagctctgctcgacgcaatggccattgagatgctggataggcacgcgactcactattgccctttagaaggggaaagctggcaagattttttacgtaataacgctaaaagtatgagatgtgctttactaagtcatcgcgatggagcaaaagtatgtttaggtacaggctttacagaacagcaatatgaaagtgccgaaaatagtatggcctttttatgccaacaaggtttttcactagagcacgcaatgtatgcaatgcaggctgctggtatttatactttaggttgcgtattgttggatcaagagcttcaagtcgctaaagaagaaagggaaacacctactactgatagtatgccgccattactccgacaagttctggaattaaatgatcaccaaggtgcagagccagccttcttattcggccttgaattgatcatatgcggattagaaaaacaacttaaatgtgaaagtgggtcttaa

SEQ ID NO: 753 - DNA, 627 bp, Artificial sequence; identical to SEQ ID NO: 752
  SuR L7-2B12 CDS

SEQ ID NO: 754 - DNA, 627 bp, Artificial sequence
  SuR L7-2C12 CDS
atgggatctagattagataaaagtaaagtgattaacagcgcattagagctgcttaatgaggtcggaatcgaaggtttaacaacccgtaaactcgcccagaagctaggtgtagagcagcctacattgtattggcatgtaaaaaataagcgagctctgctcgacgcaatggcctttgagatgctggataggcacgcgactcactattgccctttagaaggggaaagctggcaagattttttacgtaataacgctaaaagtatgagatgtgctttactaagtcatcgcgatggagcaaaagtatgtttaggtacaggctttacagaacagcaatatgaaactgccgaaaatagtatggcctttttatgccaacaaggtttttcactagagaacgcactgtatgcaatgcaggctgtttgtatttatactttaggttgcgtattgttggatcaagagcttcaagtcgctaaagaagaaagggaaacacctactactgatagtatgccgccattactccgacaagctctggaaataaaggatcaccaaggtgcagagccagccttcttattcggccttgaattgatcatatgcggattagaaaaacaacttaaatgtgaaagtgggtcytaa

SEQ ID NO: 755 - DNA, 627 bp, Artificial sequence
  SuR L7-2D12 CDS
atgggatctagattagataaaagtaaagtgattaacagcgcattagagctgcttaatgaggtcggaatcgaaggtttaacaacccgtaaactcgcccagaagctaggtgtagagcagcctacattgtattggcatgtaaaaaataagcgagctctgctcgacgcaatggccattgagatgctggataggcacgcgactcactattgccctttagaaggggaaagctggcaagattttttacgtaataacgctaaaagtatgagatgtgctttactaagtcatcgcgatggagcaaaagtatgtttaggtacaggctttacagaacagcaatatgaaactgccgaaaatagtctggcctttttatgccaacaaggtttttcactagagcacgcactgtatgcaatgcaggctgttggtatttatactttaggctgcgtattgttggatcaagagcttcaagtcgctaaagaagaaagggaaacacctactactgatagtatgccgccattagtccgacaaggtctggaattaaaggatcaccaaggtgcagagccagccttcttattcggccttgaattgatcatatgcggattagaaaaacaacttaaatgtgaaagtgggtcttaa

SEQ ID NO: 756 - DNA, 627 bp, Artificial sequence
  SuR L7-2F12 CDS
atgggatctagattagataaaagtaaagtgattaacagcgcattagagctgcttaatgaggtcggaatcgaaggtttaacaacccgtaaactcgcccagaagctaggtgtagagcagcctacattgtattggcatgtaaaaaataagcgagctctgctcgacgcattggccattgagatgctggataggcacgcgactcacgtgtgccctttagaaggggaaagctggcaagattttttacgtaataccgctaaaagtatgagatgtgctttactaagtcatcgcgatggagcaaaagtatgtttaggtacaggctttacagaacagcaatatgaagctgccgaaaatagtatggcctttttatgccaacaaggtttttcactagagcacgcgctgtatgcaatgcaggctgctggtatttttactttaggttgcgtattgttggatcaagagcttcaagtcgctaaagaagaaagggaaacacctactactgatagtatgccgccattagtccgacaagttctggaattaaaggatcaccaaggtgcagagccagccttcttattcggccttgaattgatcatatgcggattagaaaaacaacttaaatgtgaaagtgggtcttaa

SEQ ID NO: 757 - DNA, 627 bp, Artificial sequence
  SuR L7-2G12 CDS
atgggatctagattagataaaagtaaagtgattaacagcgcattagagctgcttaatgaggtcggaatcgaaggtttaacaacccgtaaactcgcccagaagctaggtgtagagcagcctacattgtattggcatgtaaaaaataagcgagctctgctcgacgcaatggccattgagatgctggataggcacgcgactcacatctgccctttagaaggggaaagctggcaagattttttacgtaataacgctaaaagtatgagatgtgctttactaagtcatcgcgatggagcaaaagtatgtttaggtacaggctttacagaacagcaatatgaagctgccgaaaatagtctggcctttttatgccaacaaggtttttcactagagcacgcactgtatgcaatgcaggctgttggtatttatactttaggttgcgtattgttggatcaagagcttcaagtcgctaaagaagaaagggaaacacctactactgatagtatgccgccattagtccgacaagctctggaattaaaggatcaccaaggtgcagagccagccttcttattcggccttgaattgatcatatgcggattagaaaaacaacttaaatgtgaaagtgggtcttaa

SEQ ID NO: 758 - DNA, 627 bp, Artificial sequence
  SuR L7-3A01 CDS
atgggatctagattagataaaagtaaagtgattaacagcgcattagagctgcttaatgaggtcggaatcgaaggtttaacaacccgtaaactcgcccagaagctaggtgtagagcagcctacattgtattggcatgtaaaaaataagcgagctctgctcgacgcattggccattgagatgctggataggcacgcgactcactattgccctttagaaggggaaagctggcaagattttttacgtaataacgctaaaagtatgagatgtgctttactaagtcatcgcgatggagcaaaagtatgtttaggtacaggctttacagaaaagcaatatgaaactgccgaaaatagtctggcctttttatgccaacaaggtttttcactagagaacgcactgtatgcaatgcaggctgttggtatttttactttaggttgcgtattgttggatcaagagcttcaagtcgctaaagaagaaagggaaacacctactactgatagtatgccgccattagtccgacaagctctggaattaaaggatcaccaaggtgcagagccagccttcttattcggccttgaattgatcatatgcggattagaaaaacaacttaaatgtgaaagtgggtcttaa

SEQ ID NO: 759 - DNA, 627 bp, Artificial sequence
  SuR L7-3C01 CDS
atgggatctagattagataaaagtaaagtgattaacagcgcattagagctgcttaatgaggtcggaatcgaaggtttaacaacccgtaaactcgcccagaagctaggtgtagagcagcctacattgtattggcatgtaaaaaataagcgagctctgctcgacgcaatggccattgagatgctggataggcacgcgactcacttgtgccctttagaaggggaaagctggcaagattttttacgtaataacgctaaaagtatgagaagtgctttactaattcatcgcgatggagcaaaagtatgtttaggtacaggctttacagaacagcaatatgaagctgccgaaaatagtatggcctttttatgccaacaaggtttttcactagagaacgcaatgtatgcaatgcaggctgttggtatttatactttaggttgcgtattgttggatcaagagcttcaagtcgctaaagaagaaagggaaacacctactactgatcgtatgccgccattagctcgacaagctctggaattaaaggatcaccaaggtgcagagccagccttcttattcggccttgaattgatcatatgcggattagaaaaacaacttaaatgtgaaagtgggtcttaa

SEQ ID NO: 760 - DNA, 627 bp, Artificial sequence
  SuR L7-3G01 CDS
atgggatctagattagataaaagtaaagtgattaacagcgcattagagctgcttaatgaggtcggaatcgaaggtttaacaacccgtaaactcgcccagaagctaggtgtagagcagcctacattgtattggcatgtaaaaaataagcgagctctgctcgacgcaatggccattgagatgctggataggcacgcgactcactattgccctttagaaggggaaagctggcaagattttttacgtaataacgctaaaagtatgagatgtgctttactaagtcatcgcgatggagcaaaagtatgtttaggtacaggctttacagaacagcaatatgaagctgccgaaaatagtctggcctttttatgccaacaaggtttttcactagagaacgcaatgtatgcaatgcaggctgctggtatttatactttaggttgcgtattgttggatcaagagcttcaagtcgctaaagaagaaagggaaacacctactactgatagtatgccgccattagtccgacaaggtctggaattaaaggatcaccaaggtgcagagccagccttcttattcggccttgaattgatcatatgcggattagaaaaacaacttaaatgtgaaagtgggtcttaa

SEQ ID NO: 761 - DNA, 627 bp, Artificial sequence
  SuR L7-3H01 CDS
atgggatctagattagataaaagtaaagtgattaacagcgcattagagctgcttaatgaggtcggaatcgaaggtttaacaacccgtaaactcgcccagaagctaggtgtagagcagcctacattgtattggcatgtaaaaaataagcgagctctgctcgacgcaatggccattgagatgctggataggcacgcgactcactattgccctttagaaggggaaagctggcaagattttttacgtaataacgctaaaagtatgagatgtgctttactaagtcatcgcgatggagcaaaagtatgtttaggtacaggctttacagaacagcaatatgaagctgccgaaaatagtatggcctttttatgccaacaaggtttttcactagagaacgcaatgtattcaatgcaggctgttggtatttttactttaggttgcgtattgttggatcaagagcttcaagtcgctaaagaagaaagggaaacacctactactgatagtatgccgccattagtccgacaaggtctggaattaaaggatcaccaaggtgcagagccagccttcttattcggccttgaattgatcatatgcggattagaaaaacaacttaaatgtgaaagtgggtcttaa

SEQ ID NO: 762 - DNA, 627 bp, Artificial sequence
  SuR L7-3A02 CDS
atgggatctagattagataaaagtaaagtgattaacagcgcattagagctgcttaatgaggtcggaatcgaaggtttaacaacccgtaaactcgcccagaagctaggtgtagagcagcctacattgtattggcatgtaaaaaataagcgagctctgctcgacgcattggccattgagatgctggataggcacgcgactcactattgccctttagaaggggaaagctggcaagattttttacgtaataacgctaaaagtatgagatgtgctttactaagtcatcgcgatggagcaaaagtatgtttaggtacaggctttacagaaaagcaatatgaaagtgccgaaaatagtctggcctttttatgccaacaaggtttttcactagagcacgcactgtatgcaatgcaggctgttggtatttatactttaggttgcgtattgttggatcaagagcttcaagtcgctaaagaagaaagggaaacacctactactgatagtatgccgccattagtccgacaagctctggaattaaaggatcaccaaggtgcagagccagccttcttattcggccttgaattgatcatatgcggatttgaaaaacaacttaaatgtgaaagtgggtcttaa

SEQ ID NO: 763 - DNA, 627 bp, Artificial sequence
  SuR L7-3B02 CDS
  misc_feature (328)..(328): n is a, c, g, or t
  misc_feature (511)..(511): n is a, c, g, or t
atgggatctagattagataaaagtaaagtgattaacagcgcattagagctgcttaatgaggtcggaatcgaaggtttaacaacccgtaaactcgcccagaagctaggtgtagagcagcctacattgtattggcatgtaaaaaataagcgagctctgctcgacgcaatggccattgagatgctggataggcacgcgactcactattgccctttagaaggggaaagctggcaagattttttacgtaataacgctaaaagtatgagatgtgctttactaagtcatcgcgatggagcaaaagtatgtttaggtacaggctttacagaacagntgtatgaaactgccgaaaatagtatggcctttttatgccaacaaggtttttcactagagaacgcactgtatgcaatgcaggctgctggtatttatactttaggttgcgtattgttggatcaagagcttcaagtcgctaaagaagaaagggaaacacctactactgatagtatgccgccattantccgacaagctctggaattaaaggatcaccaaggtgcagagccagccttcttattcggccttgaattgatcatatgcggattagaaaaacaacttaaatgtgaaagtgggtcttaa

SEQ ID NO: 764 - DNA, 627 bp, Artificial sequence
  SuR L7-3D02 CDS
atgggatctagattagataaaagtaaagtgattaacagcgcattagagctgcttaatgaggtcggaatcgaaggtttaacaacccgtaaactcgcccagaagctaggtgtagagcagcctacattgtattggcatgtaaaaaataagcgagctctgctcgacgcaatggccattgagatgctggataggcacgcgactcactattgccctttagaaggggaaagctggcaagattttttacgtaataacgctaaaagtatgagatgtgctttactaagtcatcgcgatggagcaaaagtatgtttaggtacaggctttacagaacagcaatatgaaactgccgaaaatagtatggcctttttatgccaacaaggtttttcactagagaacgcaatgtatgcaatgcaggctgctggtatttttactttaggttgcgtattgttggatcaagagcttcgagtcgctaaagaagaaagggaaacacctactactgatagtatgccgccattactccgacaagttctggaattaaaggatcaccaaggtgcagagccagccttcttattcggccttgaattgatcatatgcggattagaaaaacaacttaaatgtgaaagtgggtcttaa

SEQ ID NO: 765 - DNA, 627 bp, Artificial sequence
  SuR L7-3G02 CDS
atgggatctagattagataaaagtaaagtgattaacagcgcattagagctgcttaatgaggtcggaatcgaaggtttaacaacccgtaaactcgcccagaagctaggtgtagagcagcctacattgtattggcatgtaaaaaataagcgagctctgctcgacgcaatggccattgagatgctggataggcacgcgactcactattgccctttagaaggggaaagctggcaagattttttacgtaataacgctaaaagtatgagatgtgctttactaagtcatcgcgatggagcaaaagtatgtttaggtacaggctttacagaacagcaatatgaaactgccgaaaatagtctggcctttttatgccaacaaggtttttcactagagaacgcaatgtatgcaatgcaggctgttggtatttttactttaggttgcgtattgttggatcaagagcttcaagtcgctaaagaagaaagggaaacacctactactgatagtatgccgccattactccgacaagttctggaattaaaggatcaccaaggtgcagagccagccttcttattcggccttgaattgatcatatgcggattagaaaaacaacttaaatgtgaaagtgggtcttaa

SEQ ID NO: 766 - DNA, 627 bp, Artificial sequence
  SuR L7-3H02 CDS
atgggatctagattagataaaagtaaagtgattaacagcgcattagagctgcttaatgaggtcggaatcgaaggtttaacaacccgtaaactcgcccagaagctaggtgtagagcagcctacattgtattggcatgtaaaaaataagcgagctctgctcgacgcaatggccattgagatgctggataggcacgcgactcactattgccctttagaaggggaaagctggcaagattttttacgtaataacgctaaaagtatgagatgtgctttactaagtcatcgcgatggagcaaaagtatgtttaggtacaggctttacagaacagcaatatgaaggtgccgaaaatagtatggcctttttatgccaacaaggtttttcactagagaacgcactgtatgcaatgcaggctgttggtatttatactttaggttgcgtattgttggatcaagagcttcaagtcgctaaagaagaaagggaaacacctactactgatagtatgccgtcattagtccgacaagttctggaattaaaggatcaccaaggtgcagagccagccttcttattcggccttgaattgatcatatgcggattagaaaaacaacttaaatgtgaaagtgggtcttaa

SEQ ID NO: 767 - DNA, 627 bp, Artificial sequence
  SuR L7-3B03 CDS
  misc_feature (166)..(166): n is a, c, g, or t
  misc_feature (337)..(337): n is a, c, g, or t
atgggatctagattagataaaagtaaagtgattaacagcgcattagagctgcttaatgaggtcggaatcgaaggtttaacaacccgtaaactcgcccagaagctaggtgtagagcagcctacattgtattggcatgtaaaaaataagcgagctctgctcgacgcantggccattgagatgctggataggcacgcgactcactattgccctttagaaggggaaagctggcaagattttttacgtaataacgctaaaagtatgagatgtgctttactaagtcatcgcgatggagcaaaagtatgtttaggtacaggctttacagaacagcaatatgaanctgccgaaaatagtctggcctttttatgccaacaaggtttttcactagagcacgcactgtatgcaatgcaggctgctggtatttatactttaggttgcgtattgttggatcaagagcttcaagtcgctaaagaagaaagggaaacacctactactgatagtatgccgccattactccgacaagctctggaattaaaggatcaccaaggtgcagagccagccttcttattcggccttgaattgatcatatgcggattagaaaaacaacttaaatgtgaaagtgggtcttaa

SEQ ID NO: 768 - DNA, 627 bp, Artificial sequence
  SuR L7-3C03 CDS
atgggatctagattagataaaagtaaagtgattaacagcgcattagagctgcttaatgaggtcggaatcgaaggtttaacaacccgtaaactcgcccagaagctaggtgtagagcagcctacattgtattggcatgtaaaaaataagcgagctctgctcgacgcattggccattgagatgctggataggcacgcgactcactattgccctttagaaggggaaagctggcaagattttttacgtaataacgctaaaagtatgagatgtgctttactaagtcatcgcgatggagcaaaagtatgtttaggtacaggctttacagaacagatgtatgaaactgccgaaaatagtatggcctttttatgccaacaaggtttttcactagagaacgcaatgtatgcaatgcaggctgctggtatttatactttaggttgcgtattgttggatcaagagcttcaagtcgctaaagaagaaagggaaacacctactactgatagtatgccgccattagtccgacaaggtctggaattaaaggatcaccaaggtgcagagccagccttcttattcggccttgaattgatcatatgcggattagaaaaacaacttaaatgtgaaagtgggtcttaa

SEQ ID NO: 769 - DNA, 627 bp, Artificial sequence; identical to SEQ ID NO: 666
  SuR L7-3E03 CDS

SEQ ID NO: 770 - DNA, 627 bp, Artificial sequence
  SuR L7-3G03 CDS
atgggatctagattagataaaagtaaagtgattaacagcgcattagagctgcttaatgaggtcggaatcgaaggtttaacaacccgtaaactcgcccagaagctaggtgtagagcagcctacattgtattggcatgtaaaaaataagcgagctctgctcgacgcattggccattgagatgctggataggcacgcgactcactattgccctttagaaggggaaagctggcaagattttttacgtaataacgctaaaagtatgagatgtgctttactaagtcatcgcgatggagcaaaagtatgtttaggtacaggctttacagaaaagcaatatgaaactgccgaaaatagtatggcctttttatgccaacaaggtttttcactagagcacgcaatgtatgcaatgcaggccgctggtatttatactttaggttgcgtattgttggatcaagagcttcaagtcgctaaagaagaaagggaaacacctactactgatagtatgccgccattagtccgacaagctctggaattaaaggatcaccaaggtgcagagccagccttcttattcggccttgaattgatcatatgcggattagaaaaacaacttaaatgtgaaagtgggtcttaa

SEQ ID NO: 771 - DNA, 627 bp, Artificial sequence
  SuR L7-3H03 CDS
atgggatctagattagataaaagtaaagtgattaacagcgcattagagctgcttaatgaggtcggaatcgaaggtttaacaacccgtaaactcgcccagaagctaggtgtagagcagcctacattgtattggcatgtaaaaaataagcgagctctgctcgacgcaatggccattgagatgctggataggcacgcgactcacttgtgccctttagaaggggaaagctggcaagattttttacgtaataacgctaaaagtatgagatgtgctttactaagtcatcgcgatggagcaaaagtatgtttaggtacaggctttacagaacagatgtatgaaactgccgaaaatagtctggcctttttatgccaacaaggtttttcactagagaacgcactgtatgcaatgcaggctgctggtatttatactttaggttgcgtattgttggatcaagagcttcaagtcgctaaagaagaaagggaaacacctactactgatagtatgccgccattagtccgacaagttctggaattaaaggatcaccaaggtgcagagccagccttcttattcggccttgaattgatcatatgcggattagaaaaacaacttaaatgtgaaagtgggtcttaa

SEQ ID NO: 772 - DNA, 627 bp, Artificial sequence
  SuR L7-3B04 CDS
  misc_feature (325)..(325): n is a, c, g, or t
atgggatctagattagataaaagtaaagtgattaacagcgcattagagctgcttaatgaggtcggaatcgaaggtttaacaacccgtaaactcgcccagaagctaggtgtagagcagcctacattgtattggcatgtaaaaaataagcgagctctgctcgacgcattggccattgagatgctggataggcacgcgactcactattgccctttagaaggggaaagctggcaagattttttacgtaataacgctaaaagtatgagatgtgctttactaagtcatcgcgatggagcaaaagtatgtttaggtacaggctttacagaanagcaatatgaagctgccgaaaatagtctggcctttttatgccaacaaggtttttcactagagcacgcactgtatgcaatgcaggctgttggtatttatactttaggttgcgtattgttggatcaagagcttcaagtcgctaaagaagaaagggaaacacctactactgatagtatgccgccattagtccgacaagctctggaattaaaggatcaccaaggtgcagagccagccttcttattcggccttgaattgatcatatgcggattagaaaaacaacttaaatgtgaaagtgggtcttaa

SEQ ID NO: 773 - DNA, 627 bp, Artificial sequence
  SuR L7-3E04 CDS
atgggatctagattagataaaagtaaagtgattaacagcgcattagagctgcttaatgaggtcggaatcgaaggtttaacaacccgtaaactcgcccagaagctaggtgtagagcagcctacattgtattggcatgtaaaaaataagcgagctctgctcgacgcaatggccattgagatgctggataggcacgcgactcactattgccctttagaaggggaaagctggcaagattttttacgtaataacgctaaaagtatgagatgtgctttactaagtcatcgcgatggagcaaaagtatgtttaggtacaggctttacagaacagcaatatgaaagtgccgaaaatagtctggcctttttatgccaacaaggtttttcactagagcacgcaatgtatgcaatgcaggctgctggtatttttactttaggttgcgtattgttggatcaagagcttcaagtcgctaaagaagaaagggaaacacctactactgatagtatgccgccattagtccgacaagctctggaattaaaggatcaccaaggtgcagagccagccttcttattcggccttgaattgatcatatgcggattagaaaaacaacttaaatgtgaaagtgggtcttaa

SEQ ID NO: 774 - DNA, 627 bp, Artificial sequence
  SuR L7-3G04 CDS
atgggatctagattagataaaagtaaagtgattaacagcgcattagagctgcttaatgaggtcggaatcgaaggtttaacaacccgtaaactcgcccagaagctaggtgtagagcagcctacattgtattggcatgtaaaaaataagcgagctctgctcgacgcattggccattgagatgctggataggcacgcgacacactattgccctttagaaggggaaagctggcaagattttttacgtaataacgctaaaagtatgagatgtgctttactaagtcatcgcgatggagcaaaagtatgtttaggaacaggctttacagaacagatgtatgaaactgccgaaaatagtctggcctttttatgccaacaaggtttttcactagagcacgcaatgtatgcaatgcaggctgctggtatttttactttaggttgcgtattgttggatcaagagcttcaagtcgctaaagaagaaagggaaacacctactactgatagtatgccgccattagtccgacaagttctggaattaaaggatcaccaaggtgcagagccagccttcttattcggccttgaattgatcatatgcggattagaaaaacaacttaaatgtgaaagtgggtcttaa

SEQ ID NO: 775 - DNA, 627 bp, Artificial sequence
  SuR L7-3A05 CDS
atgggatctagattagataaaagtaaagtgattaacagcgcattagagctgcttaatgaggtcggaatcgaaggtttaacaacccgtaaactcgcccagaagctaggtgtagagcagcctacattgtattggcatgtaaaaaataagcgagctctgctcgacgcattggccattgagatgctggataggcacgcgactcactattgccctttagaaggggaaagctggcaagattttttacgtaataacgctaaaagtatgagatgtgctttactaagtcatcgcgatggagcaaaagtatgtttaggtacaggctttacagaacagatgtatgaagctgccgaaaatagtctggcctttttatgccaacaaggtttttcactagagcacgcaatgtatgcaatgcaggctgttggtatttatactttaggttgcgtattgttggatcaagagcttcaagtcgctaaagaagaaagggaaacacctactactgatagtatgccgccattagtccgacaaggtctggaattaaaggatcaccaaggtgcagagccagccttcttattcggccttgaattgatcatatgcggattagaaaaacaacttaaatgtgaaagtgggtcttaa

SEQ ID NO: 776 - DNA, 627 bp, Artificial sequence
  SuR L7-3B05 CDS
  misc_feature (166)..(166): n is a, c, g, or t
  misc_feature (203)..(204): n is a, c, g, or t
  misc_feature (329)..(330): n is a, c, g, or t
  misc_feature (388)..(388): n is a, c, g, or t
  misc_feature (415)..(415): n is a, c, g, or t
  misc_feature (422)..(422): n is a, c, g, or t
atgggatctagattagataaaagtaaagtgattaacagcgcattagagctgcttaatgaggtcggaatcgaaggtttaacaacccgtaaactcgcccagaagctaggtgtagagcagcctacattgtattggcatgtaaaaaataagcgagctctgctcgacgcantggccattgagatgctggataggcacgcgactcactnntgccctttagaaggggaaagctggcaagattttttacgtaataacgctaaaagtatgagatgtgctttactaagtcatcgcgatggagcaaaagtatgtttaggtacaggctttacagaacagcnntatgaaactgccgaaaatagtctggcctttttatgccaacaaggtttttcactagagnacgcaatgtatgcaatgcaggctgctngtatttntactttaggttgcgtattgttggatcaagagcttcaagtcgctaaagaagaaagggaaacacctactactgatagtatgccgccattagtccgacaagctctggaattaaaggatcaccaaggtgcagagccagccttcttattcggccttgaattgatcatatgcggattagaaaaacaacttaaatgtgaaagtgggtcttaa

SEQ ID NO: 777 - DNA, 627 bp, Artificial sequence
  SuR L7-3H05 CDS
  misc_feature (511)..(511): n is a, c, g, or t
atgggatctagattagataaaagtaaagtgattaacagcgcattagagctgcttaatgaggtcggaatcgaaggtttaacaacccgtaaactcgcccagaagctaggtgtagagcagcctacattgtattggcatgtaaaaaataagcgagctctgctcgacgcaatggccattgagatgctggataggcacgcgactcactattgccctttagaaggggaaagctggcaagattttttacgtaataacgctaaaagtatgagatgtgctttactaagtcatcgcgatggagcaaaagtatgtttaggtacaggctttacagaacagcaatatgaaagtgccgaaaatagtctggcctttttatgccaacaaggtttttcactagagaacgcaatgtatgcaatgcaggctgctggtatttatactttaggttgcgtattgttggatcaagagcttcaagtcgctaaagaagaaagggaaacacctactactgatagtatgccgccattantccgacaagctctggaattaaaggatcaccaaggtgcagagccagccttcttattcggccttgaattgatcatatgcggattagaaaaacaacttaaatgtgaaagtgggtcttaa

SEQ ID NO: 778 - DNA, 627 bp, Artificial sequence
  SuR L7-3B06 CDS
atgggatctagattagataaaagtaaagtgattaacagcgcattagagctgcttaatgaggtcggaatcgaaggtttaacaacccgtaaactcgcccagaagctaggtgtagagcagcctacattgtattggcatgtaaaaaataagcgagctctgctcgacgcaatggccattgagatgctggataggcacgcgactcacatctgccctttagaaggggaaagctggcaagattttttacgtaataacgctaaaagtatgagatgtgctttactaagtcatcgcgatggagcaaaagtatgtttaggtacaggctttacagaacagcaatatgaaactgccgaaaatagtctggcctttttatgccaacaaggtttttcactagagcacgcaatgtatgcaatgcaggctgctggtatttatactttaggttgcgtattgttggatcaagagcttcaagtcgctaaagaagaaagggaaacacctactactgatagtatgccgccattagtccgacaagttctggaattaaaggatcaccaaggtgcagagccagccttcttattcggccttgaattgatcatatgcggattagaaaaacaacttaaatgtgaaagtgggtcttaa

SEQ ID NO: 779 - DNA, 627 bp, Artificial sequence
  SuR L7-3D06 CDS
  misc_feature (388)..(388): n is a, c, g, or t
atgggatctagattagataaaagtaaagtgattaacagcgcattagagctgcttaatgaggtcggaatcgaaggtttaacaacccgtaaactcgcccagaagctaggtgtagagcagcctacattgtattggcatgtaaaaaataagcgagctctgctcgacgcaatggccattgagatgctggataggcacgcgactcacatgtgccctttagaaggggaaagctggcaagattttttacgtaataacgctaaaagtatgagatgtgctttactaagtcatcgcgatggagcaaaagtatgtttaggtacaggctttacagaacagcaatatgaaagtgccgaaaatagtatggcctttttatgccaacaaggtttttcactagagnacgcaatgtatgcaatgcaggctgttggtatttttactttaggttgcgtattgttggatcaagagcttcaagtcgctaaagaagaaagggaaacacctactactgatagtatgccgccattagtccgacaaggtctggaattaaaggatcaccaaggtgcagagccagccttcttattcggccttgaattgatcatatgcggattagaaaaacaacttaaatgtgaaagtgggtcttaa

SEQ ID NO: 780 - DNA, 627 bp, Artificial sequence
  SuR L7-3E06 CDS
atgggatctagattagataaaagtaaagtgattaacagcgcattagagctgcttaatgaggtcggaatcgaaggtttaacaacccgtaaactcgcccagaagctaggtgtagagcagcctacattgtattggcatgtaaaaaataagcgagctctgctcgacgcattggccattgagatgctggataggcacgcgactcactattgccctttagaaggggaaagctggcaagattttttacgtaataacgctaaaagtatgagatgtgctttactaagtcatcgcgatggagcaaaagtatgtttaggtacaggctttacagaaaagcaatatgaaagtgccgaaaatagtatggcctttttatgccaacaaggtttttcactagagcacgcactgtatgcaatgcaggctgttggtatttatactttaggttgcgtattgttggatcaagagcttcaagtcgctaaagaagaaagggaaacacctactactgatagtatgccgccattagtccgacaaggtctggaattaaaggatcaccaaggtgcagagccagccttcttattcggccttgaattgatcatatgcggattagaaaaacaacttaaatgtgaaagtgggtcttaa

SEQ ID NO: 781 - DNA, 627 bp, Artificial sequence
  SuR L7-3A07 CDS
atgggatctagattagataaaagtaaagtgattaacagcgcattagagctgcttaatgaggtcggaatcgaaggtttaacaacccgtaaactcgcccagaagctaggtgtagagcagcctacattgtattggcatgtaaaaaataagcgagctctgctcgacgcaatggccattgagatgctggataggcacgcgactcactattgccctttagaaggggaaagctggcaagattttttacgtaataacgctaaaagtatgagatgtgctttactaagtcatcgcgatggagcaaaagtatgtttaggtacaggctttacagaacagcaatatgaaggtgccgaaaatagtctggcctttttatgccaacaaggtttttcactagagcacgcaatgtatgcaatgcaggctgttggtatttttactttaggttgcgtattgttggatcaagagcttcaagtcgctaaagaagaaagggaaacacctactactgatagtatgccgccattagtccgacaaggtctggaattaaaggatcaccaaggtgcagagccagccttcttattcggccttgaattgatcatatgcggattagaaaaacaacttaaatgtgaaagtgggtcttaa

SEQ ID NO: 782 - DNA, 627 bp, Artificial sequence
  SuR L7-3C07 CDS
atgggatctagattagataaaagtaaagtgattaacagcgcattagagctgcttaatgaggtcggaatcgaaggtttaacaacccgtaaactcgcccagaagctaggtgtagagcagcctacattgtattggcatgtaaaaaataagcgagctctgctcgacgcaatggccattgagatgctggataggcacgcgactcactattgccctttagaaggggaaagctggcaagattttttacgtaataacgctaaaagtatgagatgtgctttactaagtcatcgcgatggagcaaaagtatgtttaggtacaggctttacagaacagcaatatgaaagtgccgaaaatagtctggcctttttatgccaacaaggtttttcactagagaacgcaatgtatgcaatgcaggctgttggtatttttactttaggttgcgtattgttggatcaagagcttcaagtcgctaaagaagaaagggaaacacctactactgatagtatgccgccattactccgacaagttctggaattaaaggatcaccaaggtgcagagccagccttcttattcggccttgaattgatcatatgcggattagaaaaacaacttaaatgtgaaagtgggtcttaa

SEQ ID NO: 783 - DNA, 627 bp, Artificial sequence
  SuR L7-3F07 CDS
atgggatctagattagataaaagtaaagtgattaacagcgcattagagctgcttaatgaggtcggaatcgaaggtttaacaacccgtaaactcgcccagaagctaggtgtagagcagcctacattgtattggcatgtaaaaaataagcgagctctgctcgacgcaatggccattgagatgctggataggcacgcgactcacatctgccctttagaaggggaaagctggcaagattttttacgtaataacgctaaaagtatgagatgtgctttactaagtcatcgcgatggagcaaaagtatgtttaggtacaggctttacagaacagcaatatgaaactgccgaaaatagtctggcctttttatgccaacaaggtttttcactagagaacgcaatgtatgcaatgcaggctgttggtatttatactttaggttgcgtattgttggatcaagagcttcaagtcgctaaagaagaaagggaaacacctactactgatagtatgccgccattagtccgacaagctctggaattaaaggatcaccaaggtgcagagccagccttcttattcggccttgaattgatcatatgcggattagaaaaacaacttaaatgtgaaagtgggtcttaa

SEQ ID NO: 784 - DNA, 627 bp, Artificial sequence
  SuR L7-3A08 CDS
atgggatctagattagataaaagtaaagtgattaacagcgcattagagctgcttaatgaggtcggaatcgaaggtttaacaacccgtaaactcgcccagaagctaggtgtagagcagcctacattgtattggcatgtaaaaaataagcgagctctgctcgacgcaatggccattgagatgctggataggcacgcgactcactattgccctttagaaggggaaagctggcaagattttttacgtaataacgctaaaagtatgagatgtgctttactaagtcaacgcgatggagcaaaagtatgtttaggtacaggctttacagaacagcaatatgaagctgccgaaaatagtctggcctttttatgccaacaaggtttttcactagagaacgcaatgtatgcaatgcaggctgttggtatttttactttaggttgcgtattgttggatcaagagcttcaagtcgctaaagaagaaagggaaacacctactactgatagtatgccgccattagtccgacaagctctggaattaaaggatcaccaaggtgcagagccagccttcttattcggccttgaattgatcatatgcggattagaaaaacaacttaaatgtgaaagtgggtcttaa

SEQ ID NO: 785 - DNA, 627 bp, Artificial sequence
  SuR L7-3B08 CDS
atgggatctagattagataaaagtaaagtgattaacagcgcattagagctgcttaatgaggtcggaatcgaaggtttaacaacccgtaaactcgcccagaagctaggtgtagagcagcctacattgtattggcatgtaaaaaataagcgagctctgctcgacgcaatggccattgagatgctggataggcacgcgactcactattgccctttagaaggggaaagctggcaagattttttacgtaataacgctaaaagtatgagatgtgctttactaagtcatcgcgatggagcaaaagtatgtttaggtacaggctttacagaacagcaatatgaaggggccgaaaatagtatggcctttttatgccaacaaggtttttcactagagaacgcactgtatgcaatgcaggctgttggtatttatactttaggttgcgtattgttggatcaagagcttcaagtcgctaaagaagaaagggaaacacctactactgatagtatgccgccattagtccgacaagttctggaattaaaggatcaccaaggtgcagagccagccttcttattcggccttgaattgatcatatgcggattagaaaaacaacttaaatgtgaaagtgggtcttaa

SEQ ID NO: 786 - DNA, 627 bp, Artificial sequence
  SuR L7-3C08 CDS
atgggatctagattagataaaagtaaagtgattaacagcgcattagagctgcttaatgaggtcggaatcgaaggtttaacaacccgtaaactcgcccagaagctaggtgtagagcagcctacattgtattggcatgtaaaaaataagcgagctctgctcgacgcaatggccattgagatgctggataggcacgcgactcactattgccctttagaaggggaaagctggcaagattttttacgtaataacgctaaaagtatgagatgtgctttactaagtcatcgcgatggagcaaaagtatgtttaggtacaggctttacagaacagcaatatgaaggtgccgaaaatagtatggcctttttatgccaacaaggtttttcactagagaacgcaatgtatgcaatgcaggctgctggtatttatactttaggttgcgtattgttggatcaagagcttcaagtcgctaaagaagaaagggaaacacctactactgatagtatgccgccattagtccgacaagctctggaattaaaggatcaccaaggtgcagagccagccttcttattcggccttgaattgatcatatgcggattagaaaaacaacttaaatgtgaaagtgggtcttaa

SEQ ID NO: 787 - DNA, 627 bp, Artificial sequence
  SuR L7-3F08 CDS
  misc_feature (166)..(166): n is a, c, g, or t
  misc_feature (328)..(330): n is a, c, g, or t
  misc_feature (394)..(394): n is a, c, g, or t
  misc_feature (413)..(413): n is a, c, g, or t
atgggatctagattagataaaagtaaagtgattaacagcgcattagagctgcttaatgaggtcggaatcgaaggtttaacaacccgtaaactcgcccagaagctaggtgtagagcagcctacattgtattggcatgtaaaaaataagcgagctctgctcgacgcantggccattgagatgctggataggcacgcgactcactattgccctttagaaggggaaagctggcaagattttttacgtaataacgctaaaagtatgagatgtgctttactaagtcatcgcgatggagcaaaagtatgtttaggtacaggctttacagaacagnnntatgaagctgccgaaaatagtatggcctttttatgccaacaaggtttttcactagagcacgcantgtatgcaatgcaggctgntggtatttatactttaggttgcgtattgttggatcaagagcttcaagtcgctaaagaagaaagggaaacacctactactgatagtatgccgccattagtccgacaagttctggaattaaaggatcaccaaggtgcagagccagccttcttattcggccttgaattgatcatatgcggattagaaaaacaacttaaatgtgaaagtgggtcttaa

SEQ ID NO: 788 - DNA, 627 bp, Artificial sequence
  SuR L7-3G08 CDS
  misc_feature (157)..(157): n is a, c, g, or t
  misc_feature (159)..(159): n is a, c, g, or t
  misc_feature (165)..(166): n is a, c, g, or t
  misc_feature (187)..(187): n is a, c, g, or t
  misc_feature (189)..(189): n is a, c, g, or t
  misc_feature (195)..(195): n is a, c, g, or t
  misc_feature (238)..(238): n is a, c, g, or t
  misc_feature (240)..(240): n is a, c, g, or t
  misc_feature (257)..(257): n is a, c, g, or t
  misc_feature (267)..(267): n is a, c, g, or t
  misc_feature (291)..(291): n is a, c, g, or t
  misc_feature (297)..(297): n is a, c, g, or t
  misc_feature (304)..(304): n is a, c, g, or t
  misc_feature (318)..(318): n is a, c, g, or t
  misc_feature (328)..(329): n is a, c, g, or t
  misc_feature (363)..(363): n is a, c, g, or t
  misc_feature (388)..(388): n is a, c, g, or t
  misc_feature (394)..(394): n is a, c, g, or t
  misc_feature (414)..(414): n is a, c, g, or t
  misc_feature (420)..(420): n is a, c, g, or t
  misc_feature (423)..(423): n is a, c, g, or t
  misc_feature (442)..(442): n is a, c, g, or t
  misc_feature (456)..(456): n is a, c, g, or t
  misc_feature (504)..(504): n is a, c, g, or t
  misc_feature (511)..(511): n is a, c, g, or t
  misc_feature (521)..(521): n is a, c, g, or t
  misc_feature (546)..(546): n is a, c, g, or t
  misc_feature (573)..(573): n is a, c, g, or t
  misc_feature (594)..(594): n is a, c, g, or t
atgggatctagattagataaaagtaaagtgattaacagcgcattagagctgcttaatgaggtcggaatcgaaggtttaacaacccgtaaactcgcccagaagctaggtgtagagcagcctacattgtattggcatgtaaaaaataagcgagctctgntngacgcnntggccattgagatgctggatngncacgcnactcactattgccctttagaaggggaaagctggcaagattttntncgtaataacgctaaaantatgagatgngctttactaagtcatcgcgatggngcaaangtatgtntaggtacaggcttnacagaacagnngtatgaaactgccgaaaatagtctggcctttttntgccaacaaggtttttcactagagnacgcantgtatgcaatgcaggctgtnggtatntanactttaggttgcgtattgntggatcaagagctncaagtcgctaaagaagaaagggaaacacctactactgatagtatgccnccattantccgacaagntctggaattaaaggatcaccaaggngcagagccagccttcttattcggcctngaattgatcatatgcggattngaaaaacaacttaaatgtgaaagtgggtcttaa

SEQ ID NO: 789 - DNA, 627 bp, Artificial sequence; identical to SEQ ID NO: 775
  SuR L7-3B09 CDS

SEQ ID NO: 790 - DNA, 627 bp, Artificial sequence
  SuR L7-3F09 CDS
atgggatctagattagataaaagtaaagtgattaacagcgcattagagctgcttaatgaggtcggaatcgaaggtttaacaacccgtaaactcgcccagaagctaggtgtagagcagcctacattgtattggcatgtaaaaaataagcgagctctgctcgacgcaatggccattgagatgctggataggcacgcgactcactattgccctttagaaggggaaagctggcaagattttttacgtaataacgctaaaagtatgagatgtgctttactaagtcatcgcgatggagcaaaagtatgtttaggtacaggctttacagaacagcaatatgaagctgccgaaaatagtatggcctttttatgccaacaaggtttttcactagagcacgcactgtatgcaatgcaggctgcttgtatttatactttaggttgcgtattgttggatcaagagcttcaagtcgctaaagaagaaagggaaacacctactactgatagtatgccgccattagtccgacaagctctggaattaaaggatcaccaaggtgcagagccagccttcttattcggccttgaattgatcatatgcggattagaaaaacaacttaaatgtgaaagtgggtcttaa

SEQ ID NO: 791 - DNA, 627 bp, Artificial sequence; identical to SEQ ID NO: 740
  SuR L7-3A10 CDS

SEQ ID NO: 792 - DNA, 627 bp, Artificial sequence
  SuR L7-3B10 CDS
atgggatctagattagataaaagtaaagtgattaacagcgcattagagctgcttaatgaggtcggaatcgaaggtttaacaacccgtaaactcgcccagaagctaggtgtagagcagcctacattgtattggcatgtaaaaaataagcgagctctgctcgacgcaatggccattgagatgctggataggcacgcgactcactattgccctttagaaggggaaagctggcaagattttttacgtaataacgctaaaagtatgagatgtgctttactaagtcatcgcgatggagcaaaagtatgtttaggtacaggctttacagaacagcactatgaaagtgccgaaaatagtctggcctttttatgccaacaaggtttttcactagagcacgcaatgtatgcaatgcaggctgttggtatttatactttaggttgcgtattgttggatcaagagcttcaagtcgctaaagaagaaagggaaacacctactactgatagtatgccgccattagtccgacaagctctggaattaaaggatcaccaaggtgcagagccagccttcttattcggccttgaattgatcatatgcggattagaaaaacaacttaaatgtgaaagtgggtcttaa

SEQ ID NO: 793 - DNA, 627 bp, Artificial sequence
  SuR L7-3C10 CDS
  misc_feature (413)..(413): n is a, c, g, or t
atgggatctagattagataaaagtaaagtgattaacagcgcattagagctgcttaatgaggtcggaatcgaaggtttaacaacccgtaaactcgcccagaagctaggtgtagagcagcctacattgtattggcatgtaaaaaataagcgagctctgctcgacgcaatggccattgagatgctggataggcacgcgactcactattgccctttagaaggggaaagctggcaagattttttacgtaataacgctaaaagtatgagatgtgctttactaagtcatcgcgatggagcaaaagtatgtttaggtacaggctttacagaacagcaatatgaagctgccgaaaatagtatggcctttttatgccaacaaggtttttcactagagcacgcaatgtatgcaatgcaggctgntggtatttatactttaggttgcgtattgttggatcaagagcttcaagtcgctaaagaagaaagggaaacacctactactgatagtatgccgccattagtccgacaagctctggaattaaaggatcaccaaggtgcagagccagccttcttattcggccttgaattgatcatatgcggattagaaaaacaacttaaatgtgaaagtgggtcttaa

SEQ ID NO: 794 - DNA, 627 bp, Artificial sequence
  SuR L7-3G10 CDS
atgggatctagattagataaaagtaaagtgattaacagcgcattagagctgcttaatgaggtcggaatcgaaggtttaacaacccgtaaactcgcccagaagctaggtgtagagcagcctacattgtattggcatgtaaaaaataagcgagctctgctcgacgcaatggccattgagatgctggataggcacgcgactcactattgccctttagaaggggaaagctggcaagattttttacgtaataacgctaaaagtatgagatgtgctttactaagtcatcgcgatggagcaaaagtatgtttaggtacaggctttacagaacagcaatatgaaactgccgaaaatagtatggcctttttatgccaacaaggtttttcactagagcacgcaatgtatgcaatgcaggctgctggtatttatactttaggttgcgtattgttggatcaagagcttcaagtcgctaaagaagaaagggaaacacctactactgatagtatgccgccattactccgacaagctctggaattaaaggatcaccaaggtgcagagccagccttcttattcggccttgaattgatcatatgcggattagaaaaacaacttaaatgtgaaagtgggtcttaa

SEQ ID NO: 795 - DNA, 627 bp, Artificial sequence
  SuR L7-3A11 CDS
atgggatctagattagataaaagtaaagtgattaacagcgcattagagctgcttaatgaggtcggaatcgaaggtttaacaacccgtaaactcgcccagaagctaggtgtagagcagcctacattgtattggcatgtaaaaaataagcgagctctgctcgacgcaatggccattgagatgctggataggcacgcgactcacttctgccctttagaaggggaaagctggcaagattttttacgtaataacgctaaaagtatgagatgtgctttactaagtcatcgcgatggagcaaaagtatgtttaggtacaggctttacagaacagcaatatgaaactgccgaaaatagtctggcctttttatgccaacaaggtttttcactagagaacgcactgtatgcaatgcaggctgcttgtatttatactttaggttgcgtattgttggatcaagagcttcaagtcgctaaagaagaaagggaaacacctactactgatagtatgccgccattagtccgacaagctctggaattaaaggatcaccaaggtgcagagccagccttcttattcggccttgaattgatcatatgcggattagaaaaacaacttaaatgtgaaagtgggtcttaa

SEQ ID NO: 796 - DNA, 627 bp, Artificial sequence
  SuR L7-3C11 CDS
atgggatctagattagataaaagtaaagtgattaacagcgcattagagctgcttaatgaggtcggaatcgaaggtttaacaacccgtaaactcgcccagaagctaggtgtagagcagcctacattgtattggcatgtaaaaaataagcgagctctgctcgacgcaatggccattgagatgctggataggcacgcgactcactattgccctttagaaggggaaagctggcaagattttttacgtaataacgctaaaagtatgagatgtgctttactaagtcatcgcgatggagcaaaagtatgtttaggtacaggctttacagaacagcaatatgaaagtgccgaaaatagtatggcctttttatgccaacaaggtttttcactagagaacgcaatgtatgcaatgcaggctgctggtatttatactttaggttgcgtattgttggatcaagagcttcaagtcgctaaagaagaaagggaaacacctactactgatagtatgccgccattagtccgacaaggtctggaattaaaggatcaccaaggtgcagagccagccttcttattcggccttgaattgatcatatgcggattagaaaaacaacttaaatgtgaaagtgggtcttaa

SEQ ID NO: 797 - DNA, 627 bp, Artificial sequence
  SuR L7-3E11 CDS
atgggatctagattagataaaagtaaagtgattaacagcgcattagagctgcttaatgaggtcggaatcgaaggtttaacaacccgtaaactcgcccagaagctaggtgtagagcagcctacattgtattggcatgtaaaaaataagcgagctctgctcgacgcaatggccattgagatgctggataggcacgcgactcacatgtgccctttagaaggggaaagctggcaagattttttacgtaataacgctaaaagtatgagatgtgctttactaagtcatcgcgatggagcaaaagtatgtttaggtacaggctttacagaacagcaatatgaaagtgccgaaaatagtatggcctttttatgccaacaaggtttttcactagagcacgcaatgtatgcaatgcaggctgctggtatttatactttaggttgcgtattgttggatcaagagcttcaagtcgctaaagaagaaagggaaacacctactactgatagtatgccgccattactccgacaagctctggaattaaaggatcaccaaggtgcagagccagccttcttattcggccttgaattgatcatatgcggattagaaaaacaacttaaatgtgaaagtgggtcttaa

SEQ ID NO: 798 - DNA, 627 bp, Artificial sequence
  SuR L7-3G11 CDS
  misc_feature (203)..(203): n is a, c, g, or t
  misc_feature (338)..(338): n is a, c, g, or t
  misc_feature (511)..(511): n is a, c, g, or t
  misc_feature (521)..(521): n is a, c, g, or t
atgggatctagattagataaaagtaaagtgattaacagcgcattagagctgcttaatgaggtcggaatcgaaggtttaacaacccgtaaactcgcccagaagctaggtgtagagcagcctacattgtattggcatgtaaaaaataagcgagctctgctcgacgcaatggccattgagatgctggataggcacgcgactcactnttgccctttagaaggggaaagctggcaagattttttacgtaataacgctaaaagtatgagatgtgctttactaagtcatcgcgatggagcaaaagtatgtttaggtacaggctttacagaacagcaatatgaaantgccgaaaatagtatggcctttttatgccaacaaggtttttcactagagaacgcaatgtatgcaatgcaggctgttggtatttatactttaggttgcgtattgttggatcaagagcttcaagtcgctaaagaagaaagggaaacacctactactgatagtatgccgccattantccgacaagntctggaattaaaggatcaccaaggtgcagagccagccttcttattcggccttgaattgatcatatgcggattagaaaaacaacttaaatgtgaaagtgggtcttaa

SEQ ID NO: 799 - DNA, 627 bp, Artificial sequence
  SuR L7-3A12 CDS
atgggatctagattagataaaagtaaagtgattaacagcgcattagagctgcttaatgaggtcggaatcgaaggtttaacaacccgtaaactcgcccagaagctaggtgtagagcagcctacattgtattggcatgtaaaaaataagcgagctctgctcgacgcattggccattgagatgctggataggcacgcgactcactattgccctttagaaggggaaagctggcaagattttttacgtaataacgctaaaagtatgagatgtgctttactaagtcatcgcgatggagcaaaagtatgtttaggtacaggctttacagaacagcactatgaagctgccgaaaatagtatggcctttttatgccaacaaggtttttcactagagaacgcaatgtatgcaatgcaggctgttggtatttttactttaggttgcgtattgttggatcaagagcttcaagtcgctaaagaagaaagggaaacacctactactgatagtatgccgccattagtccgacaagctctggaattaaaggatcaccaaggtgcagagccagccttcttattcggccttgaattgatcatatgcggattagaaaaacaacttaaatgtgaaagtgggtcttaa

SEQ ID NO: 800 - DNA, 627 bp, Artificial sequence
  SuR L7-3B12 CDS
atgggatctagattagataaaagtaaagtgattaacagcgcattagagctgcttaatgaggtcggaatcgaaggtttaacaacccgtaaactcgcccagaagctaggtgtagagcagcctacattgtattggcatgtaaaaaataagcgagctctgctcgacgcattggccattgagatgctggataggcacgcgactcactattgccctttagaaggggaaagctggcaagattttttacgtaataacgctaaaagtatgagatgtgctttactaagtcatcgcgatggagcaaaagtatgtttaggtacaggctttacagaacagatgtatgaaagtgccgaaaatagtatggcctttttatgccaacaaggtttttcactagagcacgcaatgtatgcaatgcaggctgctggtatttatactttaggttgcgtattgttggatcaagagcttcaagtcgctaaagaagaaagggaaacacctactactgatagtatgccgccattactccgacaagctctggaattaaaggatcaccaaggtgcagagccagccttcttattcggccttgaattgatcatatgcggattagaaaaacaacttaaatgtgaaagtgggtcttaa

SEQ ID NO: 801 - DNA, 627 bp, Artificial sequence
  SuR L7-3C12 CDS
  misc_feature (328)..(330): n is a, c, g, or t
  misc_feature (338)..(338): n is a, c, g, or t
  misc_feature (422)..(422): n is a, c, g, or t
  misc_feature (512)..(513): n is a, c, g, or t
atgggatctagattagataaaagtaaagtgattaacagcgcattagagctgcttaatgaggtcggaatcgaaggtttaacaacccgtaaactcgcccagaagctaggtgtagagcagcctacattgtattggcatgtaaaaaataagcgagctctgctcgacgcaatggccattgagatgctggataggcacgcgactcactattgccctttagaaggggaaagctggcaagattttttacgtaataacgctaaaagtatgagatgtgctttactaagtcatcgcgatggagcaaaagtatgtttaggtacaggctttacagaacagnnntatgaaantgccgaaaatagtctggcctttttatgccaacaaggtttttcactagagcacgcactgtatgcaatgcaggctgcttgtatttntactttaggttgcgtattgttggatcaagagcttcaagtcgctaaagaagaaagggaaacacctactactgatagtatgccgccattagnncgacaaggtctggaattaaaggatcaccaaggtgcagagccagccttcttattcggccttgaattgatcatatgcggattagaaaaacaacttaaatgtgaaagtgggtcttaa

SEQ ID NO: 802 - DNA, 627 bp, Artificial sequence
  SuR L7-3E12 CDS
atgggatctagattagataaaagtaaagtgattaacagcgcattagagctgcttaatgaggtcggaatcgaaggtttaacaacccgtaaactcgcccagaagctaggtgtagagcagcctacattgtattggcatgtaaaaaataagcgagctctgctcgacgcaatggccattgagatgctggataggcacgcgactcactattgccctttagaaggggaaagctggcaagattttttacgtaataacgctaaaagtatgagatgtgctttactaagtcatcgcgatggagcaaaagtatgtttaggtacaggctttacagaacagcaatatgaaagtgccgaaaatagtatggcctttttatgccaacaaggtttttcactagagcacgcaatgtatgcaatgcaggctgttggtatttatactttaggttgcgtattgttggatcaagagcttcaagtcgctaaagaagaaagggaaacacctactactgatagtatgccgccattactccgacaagctctggaattaaaggatcaccaaggtgcagagccagccttcttattcggccttgaattgatcatatgcggattagaaaaacaacttaaatgtgaaagtgggtcttaa

SEQ ID NO: 803 - DNA, 627 bp, Artificial sequence
  SuR L7-3F12 CDS
atgggatctagattagataaaagtaaagtgattaacagcgcattagagctgcttaatgaggtcggaatcgaaggtttaacaacccgtaaactcgcccagaagctaggtgtagagcagcctacattgtattggcatgtaaaaaataagcgagctctgctcgacgcaatggccattgagatgctggataggcacgcgactcacgtctgccctttagaaggggaaagctggcaagattttttacgtaataacgctaaaagtatgagatgtgctttactaagtcatcgcgatggagcaaaagtatgtttaggtacaggctttacagaacagcactatgaaagtgccgaaaatagtctggcctttttatgccaacaaggtttttcactagagcacgcactgtatgcaatgcaggctgttggtatttatactttaggttgcgtattgttggatcaagagcttcaagtcgctaaagaagaaagggaaacacctactactgatagtatgccgccattagtccgacaagctctggaattaaaggatcaccaaggtgcagagccagccttcttattcggccttgaattgatcatatgcggattagaaaaacaacttaaatgtgaaagtgggtcttaa

SEQ ID NO: 804 - DNA, 627 bp, Artificial sequence
  SuR L7-3G12 CDS
atgggatctagattagataaaagtaaagtgattaacagcgcattagagctgcttaatgaggtcggaatcgaaggtttaacaacccgtaaactcgcccagaagctaggtgtagagcagcctacattgtattggcatgtaaaaaataagcgagctctgctcgacgcaatggccattgagatgctggataggcacgcgactcacttctgccctttagaaggggaaagctggcaagattttttacgtaataacgctaaaagtatgagatgtgctttactaagtcatcgcgatggagcaaaagtatgtttaggtacaggctttacagaacagcaatatgaaactgccgaaaatagtctggcctttttatgccaacaaggtttttcactagagaacgcaatgtatgcaatgcaggctgttggtatttatactttaggttgcgtattgttggatcaagagcttcaagtcgctaaagaagaaagggaaacacctactactgatagtatgccgccattagtccgacaaggtctggaattaaaggatcaccaaggtgcagagccagccttcttattcggccttgaattgatcatatgcggattagaaaaacaacttaaatgtgaaagtgggtcttaa

SEQ ID NO: 805 - DNA, 627 bp, Artificial sequence
  SuR L7-4A01 CDS
atgggatctagattagataaaagtaaagtgattaacagcgcattagagctgcttaatgaggtcggaatcgaaggtttaacaacccgtaaactcgcccagaagctaggtgtagagcagcctacattgtattggcatgtaaaaaataagcgagctctgctcgacgcaatggccattgagatgctggataggcacgcgactcactattgccctttagaaggggaaagctggcaagattttttacgtaataacgctaaaagtatgagatgtgctttactaagtcatcgcgatggagcaaaagtatgtttaggtacaggctttacagaacagcaatatgaaactgccgaaaatagtctggcctttttatgccaacaaggtttttcactagagaacgcactgtatgcaatgcaggctgcttgtatttatactttaggttgcgtattgttggatcaagagcttcaagtcgctaaagaagaaagggaaacacctactactgatagtatgccgccattagtccgacaagttctggaattaaaggatcaccaaggtgcagagccagccttcttattcggccttgaattgatcatatgcggattagaaaaacaacttaaatgtgaaagtgggtcttaa

SEQ ID NO: 806 - DNA, 627 bp, Artificial sequence
  SuR L7-4A03 CDS
atgggatctagattagataaargkrragkgattaacagcgcattagagctgcttaatgaggtcggaatcgaaggtttaacaacccgtaaactcgcccagaagctaggtgtagagcagcctacattgtattggcatgtaaaaaataagcgagctctgctcgacgcaatggccattgagatgctggataggcacgcgactcactattgccctttagaaggggaaagctggcaagattttttacgtaataacgctaaaagtatgagatgtgctttactaagtcatcgcgatggagcaaaagtatgtttaggtacaggctttacagaacagcaatatgatactgccgaaaatagtctggcctttttatgccaacaaggtttttcactagagaacgcactgtatgcaatgcaggctgttggtatttatactttaggttgcgtattgttggatcaagagcttcaagtcgctaaagaagaaagggaaacacctactactgatagtatgccgccattagtccgacaagttctggaattaaaggatcaccaaggtgcagagccagtcttcttattcggccttgaattgatcatatgcggattagaaaaacaacttaaatgtgaaagtgggtcttaa

SEQ ID NO: 807 - DNA, 627 bp, Artificial sequence
  SuR L7-4A04 CDS
atgggatctagattagataaaagtaaagtgattaacagcgcattagagctgcttaatgaggtcggaatcgaaggtttaacaacccgtaaactcgcccagaagctaggtgtagagcagcctacattgtattggcatgtaaaaaataagcgagctctgctcgacgcattggccattgagatgctggataggcacgcgactcactattgccctttagaaggggaaagctggcaagattttttacgtaataacgctttaagtatgagatgtgctttactaagtcatcgcgatggagcaaaagtatgtttaggtacaggctttacagaaaagcaatatgaaactgccgaaaatagtatggcctttttatgccaacaaggtttttcactagagcacgcaatgtatgcaatgcaggctgctggtatttatactttaggttgcgtattgttggatcaagagcttcaagtcgctaaagaagaaagggaaacacctactactgatagtatgccgccattagtccgacaagctctggaattaaaggatcaccaaggtgcagagccagccttcttattcggccttgaattgatcatatgcggattagaaaaacaacttaaatgtgaaagtgggtcttaa

SEQ ID NO: 808 - DNA, 627 bp, Artificial sequence
  SuR L7-4A06 CDS
atgggatctagattagataaaagtaaagtgattaacagcgcattagagctgcttaatgaggtcggaatcgaaggtttaacaacccgtaaactcgcccagaagctaggtgtagagcagcctacattgtattggcatgtaaaaaataagcgagctctgctcgacgcaatggccattgagatgctggataggcacgcgactcactattgccctttagaaggggaaagctggcaagattttttacgtaataacgctaaaagtatgagatgtgctttactaagtcatcgcgatggagcaaaagtatgtttaggtacaggctttacagaacagcaatatgaaactgccgaaaatagtctggcctttttatgccaacaaggtttttcactagagaacgcaatgtatgcaatgcaggctgttggtatttatactttaggttgcgtattgttggatcaagagcttcaagtcgctaaagaagaaagggaaacacctactactgatagtatgccgccattactccgacaagttctggaattaaaggatcaccaaggtgcagagccagccttcttattcggccttgaattgatcatatgcggattagaaaaacaacttaaatgtgaaagtgggtcttaa

SEQ ID NO: 809 - DNA, 627 bp, Artificial sequence
  SuR L7-4A08 CDS
atgggatctagattagatwaaagkrragtgattaacagcgcattagagctgcttaatgaggtcggaatcgaaggtttaacaacccgtaaactcgcccagaagctaggtgtagagcagcctacattgtattggcatgtaaaaaataagcgagctctgctcgacgcaatggccattgagatgctggataggcacgcgactcactattgccctttagaaggggaaagctggcaagattttttacgtaataacgctaaaagtatgagatgtgctttactaagtcatcgcgatggagcaaaagtatgtttaggtacaggctttacagaacagcaatatgaagctgccgaaaatagtatggcctttttatgccaacaaggtttttcactagagcacgcaatgtatgcaatgcaggctgcttgtatttatactttaggttgcgtattgttggatcaagagcttcaagtcgctaaagaagaaagggaaacacctactactgatagtatgccgccattagtccgacaagctctggaattaaaggatcaccaaggtgcagagccagccttcttattcggccttgaattgatcatatgcggattagaaaaacaacttaaatgtgaaagtgggtcttaa

SEQ ID NO: 810 - DNA, 627 bp, Artificial sequence
  SuR L7-4A09 CDS
  misc_feature (166)..(166): n is a, c, g, or t
  misc_feature (330)..(330): n is a, c, g, or t
  misc_feature (511)..(511): n is a, c, g, or t
atgggatctagattagataaaagtaaagtgattaacagcgcattagagctgcttaatgaggtcggaatcgaaggtttaacaacccgtaaactcgcccagaagctaggtgtagagcagcctacattgtattggcatgtaaaaaataagcgagctctgctcgacgcantggccattgagatgctggataggcacgcgactcactattgccctttagaaggggaaagctggcaagattttttacgtaataacgctaaaagtatgagatgtgctttactaagtcatcgcgatggagcaaaagtatgtttaggtacaggctttacagaacagcantatgaaattgccgaaaatagtctggcctttttatgccaacaaggtttttcactagagcacgcaatgtatgcaatgcaggctgctggtatttatactttaggttgcgtattgttggatcaagagcttcaagtcgctaaagaagaaagggaaacacctactactgatagtatgccgccattantccgacaagctctggaattaaaggatcaccaaggtgcagagccagccttcttattcggccttgaattgatcatatgcggattagaaaaacaacttaaatgtgaaagtgggtcttaa

SEQ ID NO: 811 - DNA, 627 bp, Artificial sequence
  SuR L7-4A12 CDS
atgggatctagattagataaaagtaaagtgattaacagcgcattagagctgcttaatgaggtcggaatcgaaggtttaacaacccgtaaactcgcccagaagctaggtgtagagcagcctacattgtattggcatgtaaaaaataagcgagctctgctcgacgcattggccattgagatgctggataggcacgcgactcactattgccctttagaaggggaaagctggcaagattttttacgtaataacgctaaaagtatgagatgtgctttactaagtcatcgcgatggagcaaaagtatgtttaggtacaggctttacagaaaagcaatatgaagctgccgaaaatagtctggcctttttatgccaacaaggtttttcactagagcacgcactgtatgcaatgcaggctgttggtatttatactttaggttgcgtattgttggatcaagagcttcaagtcgctaaagaagaaagggaaacacctactactgatagtatgccgccattagtccgacaagttctggaattaaaggatcaccaaggtgcagagccagccttcttattcggccttgaattgatcatatgcggattagaaaaacaacttaaatgtgaaagtgggtcttaa

SEQ ID NO: 812 - DNA, 627 bp, Artificial sequence
  SuR L7-4B03 CDS
atgggatctagattagataaaagkrragkgattaacagcgcattagagctgcttawtgaggtcggaatcgaaggtttaacaacccgtaaactcgcccagaagctaggtgtagagcagcctacattgtattggcatgtaaaaaataagcgagctctgctcgacgcaatggccattgagatgctggataggcacgcgactcactattgccctttagaaggggaaagctggcaagattttttacgtaataacgctaaaagtatgagatgtgctttactaagtcatcgcgatggagcaaaagtatgtttaggtacaggctttacagaaaagctgtatgaaagtgccgaaaatagtctggcctttttatgccaacaaggtttttcactagagaacgcaatgtatgcaatgcaggctgtttgtatttttactttaggttgcgtattgttggatcaagagcttcaagtcgctaaagaagaaagggaaacacctactactgatagtatgccgccattactccgacaaggtctggaattaaaggatcaccaaggtgcagagccagccttcttattcggccttgaattgatcatatgcggattagaaaaacaacttaaatgtgaaagtgggtcttaa

SEQ ID NO: 813 - DNA, 627 bp, Artificial sequence
  SuR L7-4B04 CDS
atgggatctagattagataaaagtaaagtgattaacagcgcattagagctgcttaatgaggtcggaatcgaaggtttaacaacccgtaaactcgcccagaagctaggtgtagagcagcctacattgtattggcatgtaaaaaataagcgagctctgctcgacgcaatggccattgagatgctggataggcacgcgactcactattgccctttagaaggggaaagctggcaagattttttacgtaataacgctaaaagtatgagatgtgctttactaagtcatcgcgatggagcaaaagtatgtttaggtacaggctttacagaacagcaatatgaaagtgccgaaaatagtctggcctttttatgccaacaaggtttttcactagagcacgcaatgtatgcaatgcaggctgttggtatttttactttaggttgcgtattgttggatcaagagcttcaagtcgctaaagaagaaagggaaacacctactacagatagtatgccgccattactccgacaagctctggaattaaaggatcaccaaggtgcagagccagccttcttattcggccttgaattgatcatatgcggattagaaaaacaacttaaatgtgaaagtgggtcttaa

SEQ ID NO: 814 - DNA, 627 bp, Artificial sequence
  SuR L7-4B06 CDS
atgggatctagattagataaaagtaaagtgattaacagcgcattagagctgcttaatgaggtcggaatcgaaggtttaacaacccgtaaactcgcccagaagctaggtgtagagcagcctacattgtattggcatgtaaaaaataagcgagctctgctcgacgcattggccattgagatgctggataggcacgcgactcactattgccctttagaaggggaaagctggcaagattttttacgtaataacgctaaaagtatgagatgtgctttactaagtcatcgcgatggagcaaaagtatgtttaggtacaggctttacagaacagatgtatgaaggtgccgaaaatagtatggcctttttatgccaacaaggtttttcactagagcacgcaatgtatgcaatgcaggctgctggtatttatactttaggttgcgtattgttggatcaagagcttcaagtcgctaaagaagaaagggaaacacctactactgatagtatgccgccattagtccgacaagctctggaattaaaggatcaccaaggtgcagagccagccttcttattcggccttgaattgatcatatgcggattagaaaaacaacttaaatgtgaaagtgggtcttaa

SEQ ID NO: 815 - DNA, 627 bp, Artificial sequence
  SuR L7-4B07 CDS
  misc_feature (415)..(415): n is a, c, g, or t
atgggatctagattagataaaagtrargkgattaacagcgcattagagctgcttaatgaggtcggaatcgaaggtttaacaacccgtaaactcgcccagaagctaggtgtagagcagcctacattgtattggcatgtaaaaaataagcgagctctgctcgacgcaatggccattgagatgctggataggcacgcgactcactattgccctttagaaggggaaagctggcaagattttttacgtaataacgctaaaagtatgagatgtgctttactaagtcatcgcgatggagcaaaagtatgtttaggttcaggctttacagaacagcaatatgaaactgccgaaaatagtatggcctttttatgccaacaaggtttttcactagagaacgcaatgtatgcaatgcaggctgctngtatttttactttaggttgcgtattgttggatcaagagcttcaagtcgctaaagaagaaagggaaacacctactactgatagtatgccgccattagtccgacaagttctggaattaaaggatcaccaaggtgcagagccagccttcttattcggccttgaattgatcatatgcggattagaaaaacaacttaaatgtgaaagtgggtcytaa

SEQ ID NO: 816 - DNA, 627 bp, Artificial sequence
  SuR L7-4C01 CDS
atgggatctagattagataaaagtaaagtgattaacagcgcattagagctgctymwtgaggwcggaatcgaaggtttaacaacccgtaaactcgcccagaagctaggtgtagagcagcctacattgtattggcatgtaaaaaataagcgagctctgctcgacgcaatggccattgagatgctggataggcacgcgactcacatctgccctttagaagaggaaagctggcaagattttttacgtaataacgctaaaagtatgagatgtgctttactaagtcatcgcgatggagcaaaagtatgtttaggtacaggctttacagaacagcaatatgaaactgccgaaaatagtatggcctttttatgtcaacaaggtttttcactagagcacgcaatgtatgcaatgcaggctgcttgtatttatactttaggttgcgtattgttggatcaagagcttcaagtcgctaaagaagaaagggaaacacctactactgatagtatgccgccattagtccgacaagttctggaattaaaggatcaccaaggtgcagagccagccttcttattcggccttgaattgatcatatgcggattagaaaaacaacttaaatgtgaaagtgggtcttaa

SEQ ID NO: 817 - DNA, 627 bp, Artificial sequence
  SuR L7-4C03 CDS
atgggatctagattagataaaagkrargkgattaacagcgcattagagctgcttaatgaggtcggaatcgaaggtttaacaacccgtaaactcgcccagaagctaggtgtagagcagcctacattgtattggcatgtaaaaaataagcgagctctgctcgacgcaatggccattgagatgctggataggcacgcgactcacgtctgccctttagaaggggaaagctggcaagattttttacgtaataacgctaaaagtatgagatgtgctttactaagtcatcgcgatggagcaaaagtatgtttaggtacaggctttacagaacagcaatatgaaagtgccgaaaatagtctggcctttttatgccaacaaggtttttcactagagcacgcaatgtatgcaatgcaggctgctggtatttttactttaggttgcgtattgttggatcaagagcttcaagtcgctaaagaagaaagggaaacacctactactgatagtatgccgccattagtccgacaagctctggaattaaaggatcaccaaggtgcagagccagccttcttattcggccttgaattgatcatatgcggattagaaaaacaacttaaatgtgaaagtgggtcttaa

SEQ ID NO: 818 - DNA, 627 bp, Artificial sequence
  SuR L7-4C04 CDS
atgggatctagattasmtwwaagtaaagtgattaacagcgcattagagctgcttaatgaggtcggaatcgaaggtttaacaacccgtaaactcgcccagaagctaggtgtagagcagcctacattgtattggcatgtaaaaaataagcgagctctgctcgacgcaatggccattgagatgctggataggcacgcgactcacatgtgccctttagaaggggaaagctggcaagattttttacgtaataacgctaaaagtatgagatgtgctttactaagtcatcgcgatggagcaaaagtatgtttaggtacaggctttacagaacagcactatgaaactgccgaaaatagtatggcctttttatgccaacaaggtttttcactagagaacgcaatgtatgcaatgcaggctgctggtatttatactttaggttgcgtattgttggatcaagagcttcaagtcgctaaagaagaaagggaaacacctactactgatagtatgccgccattagtccgacaagttctggaattaaaggatcaccaaggtgcagagccagccttcttattcggccttgaattgatcatatgcggattagaaaaacaacttaaatgtgaaagtgggtcttaa

SEQ ID NO: 819 - DNA, 627 bp, Artificial sequence
  SuR L7-4C06 CDS
atgggatctagattagataaaagtarrgtgattaacagcgcattagagctgcttawtgaggtcggaatcgaaggtttaacaacccgtaaactcgcccagaagctaggtgtagagcagcctacattgtattggcatgtaaaaaataagcgagctctgctcgacgcaatggccattgagatgctggataggcacgcgactcactattgccctttagaaggggaaagctggcaagattttttacgtaataacgctaaaagtatgagatgtgctttactaagtcatcgcgatggagcaaaagtatgtttaggtacaggctttacagaacagcaatatgaagctgccgaaaatagtctggcctttttatgccaacaaggtttttcactagagaacgcactgtatgcaatgcaggctgttggtatttttactttaggttgcgtattgttggatcaagagcttcaagtcgctaaagaagaaagggaaacacctactactgatagtatgccgccattagtccgacaaggtctggaattaaaggatcaccaaggtgcagagccagccttcttattcggccttgaattgatcatatgcggattagaaaaacaacttaaatgtgaaagtgggtcytaa

SEQ ID NO: 820 - DNA, 627 bp, Artificial sequence
  SuR L7-4C09 CDS
atgggatctagattagataaaagtaaagtgattaacagcgcattagagctgcttaatgaggtcggaatcgaaggtttaacaacccgtaaactcgcccagaagctaggtgtagagcagcctacattgtattggcatgtaaaaaataagcgagctctgctcgacgcaatggccattgagatgctggataggcacgcgactcactattgccctttagaaggggaaagctggcaagattttttacgtaataacgctaaaagtatgagatgtgctttactaagtcatcgcgatggagcaaaagtatgtttaggtacaggctttacagaacagcaatatgaaagtgccgaaaatagtctggcctttttatgccaacaaggtttttcactagagaacgcaatgtatgcaatgcaggctgctggtatttttactttaggttgcgtattgttggatcaagagcttcaagtcgctaaagaagaaagggaaacacctactactgatagtatgccgccattagtccgacaagctctggaattaaaggatcaccaaggtgcagagccagccttcttattcggccttgaattgatcatatgcggattagaaaaacaacttaaatgtgaaagtgggtcttaa

SEQ ID NO: 821 - DNA, 627 bp, Artificial sequence
  SuR L7-4C12 CDS
atgggatctagattagataaaagtaaagtgattaacagcgcattagagctgcttaatgaggtcggaatcgaaggtttaacaacccgtaaactcgcccagaagctaggtgtagagcagcctacattgtattggcatgtaaaaaataagcgagctctgctcgacgcaatggccattgagatgctggataggcacgcgactcacttctgccctttagaaggggaaagctggcaagattttttacgtaataacgctaaaagtatgagatgtgctttactaagtcatcgcgatggagcaaaagtatgtttaggtacaggctttacagaacagcactatgaaagtgccgaaaatagtctggcctttttatgccaacaaggtttttcactagagaacgcaatgtatgcaatgcaggctgttggtatttatactttaggttgcgtattgttggatcaagagcttcaagtcgctaaagaagaaagggaaacacctactactgatagtatgccgccattagtccgacaagttctggaattaaaggatcaccaaggtgcagagccagccttcttattcggccttgaattgatcatatgcggattagaaaaacaacttaaatgtgaaagtgggtcttaa

SEQ ID NO: 822 - DNA, 627 bp, Artificial sequence
  SuR L7-4D04 CDS
atgggatctagattasataaaagtaaagtgattaacagcgcattagagctgcttaatgaggtcggaatcgaaggtttaacaacccgtaaactcgcccagaagctaggtgtagagcagcctacattgtattggcatgtaaaaaataagcgagctctgctcgacgcaatggccattgagatgctggataggcacgcgactcacgtctgccctttagaaggggaaagctggcaagattttttacgtaataacgctaaaagtatgagatgtgctttactaagtcatcgcgatggagcaaaagtatgtttaggtacaggctttacagaacagcaatatgaaactgccgaaaatagtctggcctttttatgccaacaaggtttttcactagagcacgcactgtatgcaatgcaggctgttggtatttatactttaggttgcgtattgttggatcaagagcttcaagtcgctaaagaagaaagggaaacacctactactgatagtatgccgccattagtccgacaagttctggaattaaaggatcaccaaggtgcagagccagccttcttattcggccttgaattgatcatatgcggattagaaaaacaacttaaatgtgaaagtgggtcttaa

SEQ ID NO: 823 - DNA, 627 bp, Artificial sequence
  SuR L7-4D07 CDS
atgggatctagattmsmtwaaagtraagtgattaacagcgcattagagctgcttaatgaggtcggaatcgaaggtttaacaacccgtaaactcgcccagaagctaggtgtagagcagcctacattgtattggcatgtaaaaaataagcgagctctgctcgacgcattggccattgagatgctggataggcacgcgactcactattgccctttagaaggggaaagctggcaagattttttacgtaataacgctaaaagtatgagatgtgctttactaagtcatcgcgatggagcaaaagtatgtttaggtacaggctttacagaaaagcaatatgaagctgccgaaaatagtatggcctttttatgccaacaaggtttttcactagagcacgcactgtatgcaatgcaggctgttggtatttatactttaggttgcgtattgttggatcaagagcttcaagtcgctaaagaagaaagggaaacacctactactgatagtatgccgccattagtccgacaagctctggaattaaaggatcaccaaggtgcagagccagccttcttattcggccttgaattgatcatatgcggattagaaaaacaacttaaatgtgaaagtgggtcytaa

SEQ ID NO: 824 - DNA, 627 bp, Artificial sequence
  SuR L7-4D08 CDS
atgggatctagattagwtwaamgkrragygattaacagcgcattagagctgcttaatgaggtcggaatcgaaggtttaacaacccgtaaactcgcccagaagctaggtgtagagcagcctacattgtattggcatgtaaaaaataagcgagctctgctcgacgcaatggccattgagatgctggataggcacgcgactcactattgccctttagaaggggaaagctggcaagattttttacgtaataacgctaaaagtatgagatgtgctttactaagtcatcgcgatggagcaaaagtatgtttaggtacaggctttacagaacagcaatatgaaagtgccgaaaatagtatggcctttttatgccaacaaggtttttcactagagaacgcaatgtatgcaatgcaggctgctggtatttttactttaggttgcgtattgttggatcaagagcttcaagtcgctaaagaagaaagggaaacacctactactgatagtatgccgccattactccgacaagttctggaattaaaggatcaccaaggtgcagagccagccttcttattcggccttgaattgatcatatgcggattagaaaaacaacttaaatgtgaaagtgggtcyyma

SEQ ID NO: 825 - DNA, 627 bp, Artificial sequence
  SuR L7-4D10 CDS
atgggatctagattagatwaaagtarrgkgattaacagcgcattagagctgcttawtgaggtcggaatcgaaggtttaacaacccgtaaactcgcccagaagctaggtgtagagcagcctacattgtattggcatgtaaaaaataagcgagctctgctcgacgcaatggccattgagatgctggataggcacgcgactcacttctgccctttagaaggggaaagctggcaagattttttacgtaataacgctaaaagtatgagatgtgctttactaagtcatcgcgatggagcaaaagtatgtttaggtacaggctttacagaacagcaatatgaagctgccgaaaatagtatggcctttttatgccaacaaggtttttcactagagaacgcaatgtatgcaatgcaggctgttggtatttttactttaggttgcgtattgttggatcaagagcttcaagtcgctaaagaagaaagggaaacacctactactgatagtatgccgccattagtccgacaagttctggaattaaaggatcaccaaggtgcagagccagccttcttattcggccttgaattgatcatatgcggattagaaaaacaacttaaatgtgaaagtgggtcttaa

SEQ ID NO: 826 - DNA, 627 bp, Artificial sequence
  SuR L7-4D11 CDS
atgggatctagattasatwaaagtaaagtgattaacagcgcattagagctgcttaatgaggtcggaatcgaaggtttaacaacccgtaaactcgcccagaagctaggtgtagagcagcctacattgtattggcatgtaaaaaataagcgagctctgctcgacgcaatggccattgagatgctggataggcacgcgactcactattgccctttagaaggggaaagctggcaagattttttacgtaataacgctaaaagtatgagatgtgctttactaagtcatcgcgatggagcaaaagtatgtttaggtacaggctttacagaacagcaatatgaaactgccgaaaatagtatggcctttttatgccaacaaggtttttcactagagcacgcaatgtatgcaatgcaggctgttggtatttatactttaggttgcgtattgttggatcaagagcttcaagtcgctaaagaagaaagggaaacacctactactgatagtatgccgccattactccgacaagttctggaattaaaggatcaccaaggtgcagagccagccttcttattcggccttgaattgatcatatgcggattagaaaaacaacttaaatgtgaaagtgggtcttaa

SEQ ID NO: 827 - DNA, 627 bp, Artificial sequence
  SuR L7-4E01 CDS
atgggatctagattagataaaagtaaagtgattaacagcgcattagagctgcttaatgaggtcggaatcgaaggtttaacaacccgtaaactcgcccagaagctaggtgtagagcagcctacattgtattggcatgtaaaaaataagcgagctctgctcgacgcaatggccatggagatgctggataggcacgcgactcactattgccctttagaaggggaaagctggcaagattttttacgtaataacgctaaaagtatgagatgtgctttactaagtcatcgcgatggagcaaaagtatgtttaggtacaggctttacagaacagcaatatgaaagtgccgaaaatagtatggcctttttatgccaacaaggtttttcactagagaacgcactgtatgcaatgcaggctgttggtatttatactttaggttgcgtattgttggatcaagagcttcaagtcgctaaagaagaaagggaaacacctactactgatagtatgccgccattagtccgacaaggtctggaattaaaggatcaccaaggtgcagagccagccttcttattcggccttgaattgatcatatgcggattagaaaaacaacttaaatgtgaaagtgggtcttaa

SEQ ID NO: 828 - DNA, 627 bp, Artificial sequence
  SuR L7-4E02 CDS
  misc_feature (536)..(536): n is a, c, g, or t
atgggatctagattagataaaagtaaagtgattaacagcgcattagagctgcttaatgaggtcggaatcgaaggtttaacaacccgtaaactcgcccagaagctaggtgtagagcagcctacattgtattggcatgtaaaaaataagcgagctctgctcgacgcattggccattgagatgctggataggcacgcgactcactattgccctttagaaggggaaagctggcaagattttttacgtaataacgctaaaagtatgagatgtgctttactaagtcatcgcgatggagcaaaagtatgtttaggtacaggctttacagaacagcaatatgaagctgccgaaaatagtctggcctttttatgccaacaaggtttttcactagagcacgcactgtatgcaatgcaggctgctggtatttatactttaggttgcgtattgttggatcaagagcttcaagtcgctaaagaagaaagggaaacacctactactgatagtatgccgccattactccgacaaggtctggaattaaaggntcaccaaggtgcagagccagccttcttattcggccttgaattgatcatatgcggattagaaaaacaacttaaatgtgaaagtgggtcttaa

SEQ ID NO: 829 - DNA, 627 bp, Artificial sequence
  SuR L7-4E04 CDS
atgggatctagattmsmtwwaagkraagtgattaacagcgcattagagctgcttaatgaggtcggaatcgaaggtttaacaacccgtaaactcgcccagaagctaggtgtagagcagcctacattgtattggcatgtaaaaaataagcgagctctgctcgacgcaatggccattgagatgctggataggcacgcgactcactattgccctttagaaggggaaagctggcaagattttttacgtaataacgctaaaagtatgagatgtgctttactaagtcatcgcgatggagcaaaagtatgtttaggtacaggctttacagaacagcaatatgaaactgccgaaaatagtctggcctttttatgccaacaaggtttttcactagagaacgcaatgtatgcaatgcaggctgctggtatttatactttaggttgcgtattgttggatcaagagcttcaagtcgctaaagaagaaagggaaacacctactactgatagtatgccgccattactccgacaagttctggaattaaaggatcaccaaggtgcagagccagccttcttattcggccttgaattgatcatatgcggattagaaaaacaacttaaatgtgaaagtgggtcytaa

SEQ ID NO: 830 - DNA, 627 bp, Artificial sequence; identical to SEQ ID NO: 732
  SuR L7-4E05 CDS

SEQ ID NO: 831 - DNA, 627 bp, Artificial sequence
  SuR L7-4E07 CDS
atgggatctagattagataaaagtaaagtgattaacagcgcattagagctgcttaatgaggtcggaatcgaaggtttaacaacccgtaaactcgcccagaagctaggtgtagagcagcctacattgtattggcatgtaaaaaataagcgagctctgctcgacgcaatggccattgagatgctggataggcacgcgactcactattgccctttagaaggggaaagctggcaagattttttacgtaataacgctaaaagtatgagatgtgctttactaagtcatcgcgatggagcaaaagtatgtttaggtacaggctttacagaacagcaatatgaaactgccgaaaatagtatggcctttttatgccaacaaggtttttcactagagaacgcactgtatgcaatgcaggctgctggtatttttactttaggttgcgtattgttggatcaagagcttcaagtcgctaaagaagaaagggaaacacctactactgatagtatgccgccattagtccgacaagttctggaattaaaggatcaccaaggtgcagagccagccttcttattcggccttgaattgatcatatgcggattagaaaaacaacttaaatgtgaaagtgggtcttaa

SEQ ID NO: 832 - DNA, 627 bp, Artificial sequence
  SuR L7-4E08 CDS
atgggatctagattagataaaagtaaagtgattaacagcgcattagagctgcttaatgaggtcggaatcgaaggtttaacaacccgtaaactcgcccagaagctaggtgtagagcagcctacattgtattggcatgtaaaaaataagcgagctctgctcgacgcaatggccattgagatgctggataggcacgcgactcacatctgccctttagaaggggaaagctggcaagattttttacgtaataacgctaaaagtatgagatgtgctttactaagtcatcgcgatggagcaaaagtatgtttaggtacaggctttacagaacagcaatatgaaactgccgaaaatagtatggcctttttatgccaacaaggtttttcactagagaacgcaatgtatgcaatgcaggctgtttgtatttatactttaggttgcgtattgttggatcaagagcttcaagtcgctaaagaagaaagggaaacacctactactgatagtatgccgccattagtccgacaagctctggaattaaaggatcaccaaggtgcagagccagccttcttattcggccttgaattgatcatatgcggattagaaaaacaacttaaatgtgaaagtgggtcttaa

SEQ ID NO: 833 - DNA, 42 bp, Artificial sequence
  Oligo L1:01
tattggcatgtaaaaaataagcgagctctgctcgacgcctta

SEQ ID NO: 834 - DNA, 41 bp, Artificial sequence
  Oligo L1:02
gccattgagatgawggataggcaccwgactcactttgccct

SEQ ID NO: 835 - DNA, 41 bp, Artificial sequence
  Oligo L1:03
gccattgagatgawggataggcacmatactcactttgccct

SEQ ID NO: 836 - DNA, 41 bp, Artificial sequence
  Oligo L1:04
gccattgagatgawggataggcacgcgactcactttgccct

SEQ ID NO: 837 - DNA, 41 bp, Artificial sequence
  Oligo L1:05
gccattgagatgacggataggcaccwgactcactttgccct

SEQ ID NO: 838 - DNA, 41 bp, Artificial sequence
  Oligo L1:06
gccattgagatgacggataggcacmatactcactttgccct

SEQ ID NO: 839 - DNA, 41 bp, Artificial sequence
  Oligo L1:07
gccattgagatgacggataggcacgcgactcactttgccct

SEQ ID NO: 840 - DNA, 41 bp, Artificial sequence
  Oligo L1:08
gccattgagatgatggataggcaccwgactcactttgccct

SEQ ID NO: 841 - DNA, 41 bp, Artificial sequence
  Oligo L1:09
gccattgagatgatggataggcacmatactcactttgccct

SEQ ID NO: 842 - DNA, 41 bp, Artificial sequence
  Oligo L1:10
gccattgagatgatggataggcacgcgactcactttgccct

SEQ ID NO: 843 - DNA, 42 bp, Artificial sequence
  Oligo L1:11
ttagaaggggaaagctggcaagattttttacgtaataacgct

SEQ ID NO: 844 - DNA, 42 bp, Artificial sequence
  Oligo L1:12
ttagaaggggaaagctggcaagattttttacgtaatdctgct

SEQ ID NO: 845 - DNA, 42 bp, Artificial sequence
  Oligo L1:13
aaaagttwtagatgtgctttactaagtcatcgcgatggagca

SEQ ID NO: 846 - DNA, 42 bp, Artificial sequence
  Oligo L1:14
aaaagttggagatgtgctttactaagtcatcgcgatggagca

SEQ ID NO: 847 - DNA, 42 bp, Artificial sequence
  Oligo L1:15
aaaagtatgagatgtgctttactaagtcatcgcgatggagca

SEQ ID NO: 848 - DNA, 42 bp, Artificial sequence
  Oligo L1:16
  misc_feature (7)..(8): n is a, c, g, or t
  misc_feature (22)..(23): n is a, c, g, or t
aaagtannkttaggtacagcgnnkacagaaaaacagtatgaa

SEQ ID NO: 849 - DNA, 42 bp, Artificial sequence
  Oligo L1:17
  misc_feature (7)..(8): n is a, c, g, or t
  misc_feature (22)..(23): n is a, c, g, or t
aaagtannkttaggtacasgcnnkacagaaaaacagtatgaa

SEQ ID NO: 850 - DNA, 42 bp, Artificial sequence
  Oligo L1:18
  misc_feature (5)..(5): n is a, c, g, or t
  misc_feature (13)..(14): n is a, c, g, or t
actvnsgaaaatnnkttagcctttttatgccaacaaggtttt

SEQ ID NO: 851 - DNA, 42 bp, Artificial sequence
  Oligo L1:19
  misc_feature (25)..(26): n is a, c, g, or t
  misc_feature (37)..(38): n is a, c, g, or t
  misc_feature (40)..(41): n is a, c, g, or t
tcactagagaatgcattatatgcannsrccgctgtgnnknnk

SEQ ID NO: 852 - DNA, 42 bp, Artificial sequence
  Oligo L1:20
  misc_feature (25)..(26): n is a, c, g, or t
  misc_feature (37)..(38): n is a, c, g, or t
  misc_feature (40)..(41): n is a, c, g, or t
tcactagagaatgcattatatgcannsmgcgctgtgnnknnk

SEQ ID NO: 853 - DNA, 42 bp, Artificial sequence
  Oligo L1:21
  misc_feature (25)..(26): n is a, c, g, or t
  misc_feature (37)..(38): n is a, c, g, or t
  misc_feature (40)..(41): n is a, c, g, or t
tcactagagaatgcattatatgcannsmakgctgtgnnknnk

SEQ ID NO: 854 - DNA, 42 bp, Artificial sequence
  Oligo L1:22
  misc_feature (22)..(23): n is a, c, g, or t
  misc_feature (34)..(35): n is a, c, g, or t
tttactttaggttgcgtattgnnkgatcaagagnnkcaagtc

SEQ ID NO: 855 - DNA, 42 bp, Artificial sequence
  Oligo L1:23
gctaaagaagaaagggaaacacctactactgatagtatgccg

SEQ ID NO: 856 - DNA, 42 bp, Artificial sequence
  Oligo L1:24
  misc_feature (19)..(20): n is a, c, g, or t
  misc_feature (28)..(29): n is a, c, g, or t
ccattattacgacaagctnnkgaattannkgatcaccaaggt

SEQ ID NO: 857 - DNA, 42 bp, Artificial sequence
  Oligo L1:25
gcagagccagccttcttattcggccttgaattgatcatatgc

SEQ ID NO: 858 - DNA, 42 bp, Artificial sequence
  Oligo L1:26
ggattagaaaaacaacttaaatgtgaaagtgggtcttaaggc

SEQ ID NO: 859 - DNA, 42 bp, Artificial sequence
  Oligo L1:27
cctatccwtcatctcaatggctaaggcgtcgagcagagctcg

SEQ ID NO: 860 - DNA, 42 bp, Artificial sequence
  Oligo L1:28
cctatccgccatctcaatggctaaggcgtcgagcagagctcg

SEQ ID NO: 861 - DNA, 42 bp, Artificial sequence
  Oligo L1:29
cctatccagcatctcaatggctaaggcgtcgagcagagctcg

SEQ ID NO: 862 - DNA, 42 bp, Artificial sequence
  Oligo L1:30
ttgccagctttccccttctaaagggcaaaagtgagtcwggtg

SEQ ID NO: 863 - DNA, 42 bp, Artificial sequence
  Oligo L1:31
ttgccagctttccccttctaaagggcaaaagtgagtatkgtg

SEQ ID NO: 864 - DNA, 42 bp, Artificial sequence
  Oligo L1:32
ttgccagctttccccttctaaagggcaaaagtgagtcgcgtg

SEQ ID NO: 865 - DNA, 42 bp, Artificial sequence
  Oligo L1:33
taaagcacatctawaacttttagcgttattacgtaaaaaatc

SEQ ID NO: 866 - DNA, 42 bp, Artificial sequence
  Oligo L1:34
taaagcacatctccaacttttagcgttattacgtaaaaaatc

SEQ ID NO: 867 - DNA, 42 bp, Artificial sequence
  Oligo L1:35
taaagcacatctcatacttttagcgttattacgtaaaaaatc

SEQ ID NO: 868 - DNA, 42 bp, Artificial sequence
  Oligo L1:36
taaagcacatctawaacttttagcaghattacgtaaaaaatc

SEQ ID NO: 869 - DNA, 42 bp, Artificial sequence
  Oligo L1:37
taaagcacatctccaacttttagcaghattacgtaaaaaatc

SEQ ID NO: 870 - DNA, 42 bp, Artificial sequence
  Oligo L1:38
taaagcacatctcatacttttagcaghattacgtaaaaaatc

SEQ ID NO: 871 - DNA, 42 bp, Artificial sequence
  Oligo L1:39
  misc_feature (14)..(15): n is a, c, g, or t
cgctgtacctaamnntacttttgctccatcgcgatgacttag

SEQ ID NO: 872 - DNA, 42 bp, Artificial sequence
  Oligo L1:40
  misc_feature (14)..(15): n is a, c, g, or t
gcstgtacctaamnntacttttgctccatcgcgatgacttag

SEQ ID NO: 873 - DNA, 42 bp, Artificial sequence
  Oligo L1:41
  misc_feature (8)..(9): n is a, c, g, or t
  misc_feature (17)..(17): n is a, c, g, or t
  misc_feature (41)..(42): n is a, c, g, or t
ggctaamnnattttcsnbagtttcatactgtttttctgtmnn

SEQ ID NO: 874 - DNA, 42 bp, Artificial sequence
  Oligo L1:42
atataatgcattctctagtgaaaaaccttgttggcataaaaa

SEQ ID NO: 875 - DNA, 42 bp, Artificial sequence
  Oligo L1:43
  misc_feature (23)..(24): n is a, c, g, or t
  misc_feature (26)..(27): n is a, c, g, or t
  misc_feature (38)..(39): n is a, c, g, or t
caatacgcaacctaaagtaaamnnmnncacagcggysnntgc

SEQ ID NO: 876 - DNA, 42 bp, Artificial sequence
  Oligo L1:44
  misc_feature (23)..(24): n is a, c, g, or t
  misc_feature (26)..(27): n is a, c, g, or t
  misc_feature (38)..(39): n is a, c, g, or t
caatacgcaacctaaagtaaamnnmnncacagcgcksnntgc

SEQ ID NO: 877 - DNA, 42 bp, Artificial sequence
  Oligo L1:45
  misc_feature (23)..(24): n is a, c, g, or t
  misc_feature (26)..(27): n is a, c, g, or t
  misc_feature (38)..(39): n is a, c, g, or t
caatacgcaacctaaagtaaamnnmnncacagcmtksnntgc

SEQ ID NO: 878 - DNA, 42 bp, Artificial sequence
  Oligo L1:46
  misc_feature (29)..(30): n is a, c, g, or t
  misc_feature (41)..(42): n is a, c, g, or t
tgtttccctttcttctttagcgacttgmnnctcttgatcmnn

SEQ ID NO: 879 - DNA, 42 bp, Artificial sequence
  Oligo L1:47
  misc_feature (2)..(3): n is a, c, g, or t
mnnagcttgtcgtaataatggcggcatactatcagtagtagg

SEQ ID NO: 880 - DNA, 42 bp, Artificial sequence
  Oligo L1:48
  misc_feature (35)..(36): n is a, c, g, or t
gaataagaaggctggctctgcaccttggtgatcmnntaattc

SEQ ID NO: 881 - DNA, 42 bp, Artificial sequence
  Oligo L1:49
tttaagttgtttttctaatccgcatatgatcaattcaaggcc

SEQ ID NO: 882 - DNA, 35 bp, Artificial sequence
  Oligo L1:50
gggaacttcggcgcgccttaagacccactttcaca

SEQ ID NO: 883 - DNA, 24 bp, Artificial sequence
  Oligo L1:5'
catgtaaaaaataagcgagctctg

SEQ ID NO: 884 - DNA, 24 bp, Artificial sequence
  Oligo L1:3'
gggaacttcggcgcgccttaagac

SEQ ID NO: 885 - DNA, 42 bp, Artificial sequence; identical to SEQ ID NO: 833
  Oligo L2:01

SEQ ID NO: 886 - DNA, 42 bp, Artificial sequence
  Oligo L2:02
gccattgagatgwtggataggcaccasactcacttttgccct

SEQ ID NO: 887 - DNA, 42 bp, Artificial sequence
  Oligo L2:03
gccattgagatgwtggataggcacgcaactcacttttgccct

SEQ ID NO: 888 - DNA, 42 bp, Artificial sequence
  Oligo L2:04
ttagaaggggaaagctggcaagattttttacgtaatamtgct

SEQ ID NO: 889 - DNA, 42 bp, Artificial sequence
  Oligo L2:05
aaaagttacagatgtgctttactaagtcatcgcgatggagca

SEQ ID NO: 890 - DNA, 42 bp, Artificial sequence; identical to SEQ ID NO: 847
  Oligo L2:06

SEQ ID NO: 891 - DNA, 42 bp, Artificial sequence
  Oligo L2:07
aaagtatrtttaggtacacgcdtcacagaaaaacagtatgaa

SEQ ID NO: 892 - DNA, 42 bp, Artificial sequence
  Oligo L2:08
aaagtatrtttaggtacacgctggacagaaaaacagtatgaa

SEQ ID NO: 893 - DNA, 42 bp, Artificial sequence
  Oligo L2:09
aaagtatrtttaggtacagstdtcacagaaaaacagtatgaa

SEQ ID NO: 894 - DNA, 42 bp, Artificial sequence
  Oligo L2:10
aaagtatrtttaggtacagsttggacagaaaaacagtatgaa

SEQ ID NO: 895 - DNA, 42 bp, Artificial sequence
  Oligo L2:11
aaagtatggttaggtacacgcdtcacagaaaaacagtatgaa

SEQ ID NO: 896 - DNA, 42 bp, Artificial sequence
  Oligo L2:12
aaagtatggttaggtacacgctggacagaaaaacagtatgaa

SEQ ID NO: 897 - DNA, 42 bp, Artificial sequence
  Oligo L2:13
aaagtatggttaggtacagstdtcacagaaaaacagtatgaa

SEQ ID NO: 898 - DNA, 42 bp, Artificial sequence
  Oligo L2:14
aaagtatggttaggtacagsttggacagaaaaacagtatgaa

SEQ ID NO: 899 - DNA, 42 bp, Artificial sequence
  Oligo L2:15
actaaagaaaatarcttagcctttttatgccaacaaggtttt

SEQ ID NO: 900 - DNA, 42 bp, Artificial sequence
  Oligo L2:16
actaaagaaaatcaattagcctttttatgccaacaaggtttt

SEQ ID NO: 901 - DNA, 42 bp, Artificial sequence
  Oligo L2:17
actaaagaaaatatgttagcctttttatgccaacaaggtttt

SEQ ID NO: 902 - DNA, 42 bp, Artificial sequence
  Oligo L2:18
actsctgaaaatarcttagcctttttatgccaacaaggtttt

SEQ ID NO: 903 - DNA, 42 bp, Artificial sequence
  Oligo L2:19
actsctgaaaatcaattagcctttttatgccaacaaggtttt

SEQ ID NO: 904 - DNA, 42 bp, Artificial sequence
  Oligo L2:20
actsctgaaaatatgttagcctttttatgccaacaaggtttt

SEQ ID NO: 905 - DNA, 42 bp, Artificial sequence
  Oligo L2:21
tcactagagaatgcattatatgcartgagtgctgtggctawt

SEQ ID NO: 906 - DNA, 42 bp, Artificial sequence
  Oligo L2:22
tcactagagaatgcattatatgcartgagtgctgtggctgkt

SEQ ID NO: 907 - DNA, 42 bp, Artificial sequence
  Oligo L2:23
tcactagagaatgcattatatgcartgagtgctgtgygcawt

SEQ ID NO: 908 - DNA, 42 bp, Artificial sequence
  Oligo L2:24
tcactagagaatgcattatatgcartgagtgctgtgygcgkt

SEQ ID NO: 909 - DNA, 42 bp, Artificial sequence
  Oligo L2:25
tcactagagaatgcattatatgcartgmaagctgtggctawt

SEQ ID NO: 910 - DNA, 42 bp, Artificial sequence
  Oligo L2:26
tcactagagaatgcattatatgcartgmaagctgtggctgkt

SEQ ID NO: 911 - DNA, 42 bp, Artificial sequence
  Oligo L2:27
tcactagagaatgcattatatgcartgmaagctgtgygcawt

SEQ ID NO: 912 - DNA, 42 bp, Artificial sequence
  Oligo L2:28
tcactagagaatgcattatatgcartgmaagctgtgygcgkt

SEQ ID NO: 913 - DNA, 42 bp, Artificial sequence
  Oligo L2:29
tcactagagaatgcattatatgcawggagtgctgtggctawt

SEQ ID NO: 914 - DNA, 42 bp, Artificial sequence
  Oligo L2:30
tcactagagaatgcattatatgcawggagtgctgtggctgkt

SEQ ID NO: 915 - DNA, 42 bp, Artificial sequence
  Oligo L2:31
tcactagagaatgcattatatgcawggagtgctgtgygcawt

SEQ ID NO: 916 - DNA, 42 bp, Artificial sequence
  Oligo L2:32
tcactagagaatgcattatatgcawggagtgctgtgygcgkt

SEQ ID NO: 917 - DNA, 42 bp, Artificial sequence
  Oligo L2:33
tcactagagaatgcattatatgcawggmaagctgtggctawt

SEQ ID NO: 918 - DNA, 42 bp, Artificial sequence
  Oligo L2:34
tcactagagaatgcattatatgcawggmaagctgtggctgkt

SEQ ID NO: 919 - DNA, 42 bp, Artificial sequence
  Oligo L2:35
tcactagagaatgcattatatgcawggmaagctgtgygcawt

SEQ ID NO: 920 - DNA, 42 bp, Artificial sequence
  Oligo L2:36
tcactagagaatgcattatatgcawggmaagctgtgygcgkt

SEQ ID NO: 921 - DNA, 42 bp, Artificial sequence
  Oligo L2:37
tttactttaggttgcgtattgtkggatcaagagagmcaagtc

SEQ ID NO: 922 - DNA, 42 bp, Artificial sequence
  Oligo L2:38
tttactttaggttgcgtattgtkggatcaagagmtgcaagtc

SEQ ID NO: 923 - DNA, 42 bp, Artificial sequence
  Oligo L2:39
tttactttaggttgcgtattgtytgatcaagagagmcaagtc

SEQ ID NO: 924 - DNA, 42 bp, Artificial sequence
  Oligo L2:40
tttactttaggttgcgtattgtytgatcaagagmtgcaagtc

SEQ ID NO: 925 - DNA, 42 bp, Artificial sequence
  Oligo L2:41
gctaaagaagaaagggaaacacctactactgmtagtatgccg

SEQ ID NO: 926 - DNA, 42 bp, Artificial sequence
  Oligo L2:42
ccattattacgacaagctagtgaattattggatcaccaaggt

SEQ ID NO: 927 - DNA, 42 bp, Artificial sequence
  Oligo L2:43
ccattattacgacaagctagtgaattakcagatcaccaaggt

SEQ ID NO: 928 - DNA, 42 bp, Artificial sequence
  Oligo L2:44
ccattattacgacaagctagtgaattaaaggatcaccaaggt

SEQ ID NO: 929 - DNA, 42 bp, Artificial sequence
  Oligo L2:45
ccattattacgacaagcttkggaattattggatcaccaaggt

SEQ ID NO: 930 - DNA, 42 bp, Artificial sequence
  Oligo L2:46
ccattattacgacaagcttkggaattakcagatcaccaaggt

SEQ ID NO: 931 - DNA, 42 bp, Artificial sequence
  Oligo L2:47
ccattattacgacaagcttkggaattaaaggatcaccaaggt

SEQ ID NO: 932 - DNA, 42 bp, Artificial sequence
  Oligo L2:48
ccattattacgacaagctgtagaattattggatcaccaaggt

SEQ ID NO: 933 - DNA, 42 bp, Artificial sequence
  Oligo L2:49
ccattattacgacaagctgtagaattakcagatcaccaaggt

SEQ ID NO: 934 - DNA, 42 bp, Artificial sequence
  Oligo L2:50
ccattattacgacaagctgtagaattaaaggatcaccaaggt

SEQ ID NO: 935 - DNA, 42 bp, Artificial sequence; identical to SEQ ID NO: 857
  Oligo L2:51

SEQ ID NO: 936 - DNA, 39 bp, Artificial sequence
  Oligo L2:52
ggattagaaaaacaacttaaatscgaaagtgggtcttaa

SEQ ID NO: 937 - DNA, 42 bp, Artificial sequence
  Oligo L2:53
cctatccawcatctcaatggctaaggcgtcgagcagagctcg

SEQ ID NO: 938 - DNA, 42 bp, Artificial sequence
  Oligo L2:54
ttgccagctttccccttctaaagggcaaaagtgagtstggtg

SEQ ID NO: 939 - DNA, 42 bp, Artificial sequence
  Oligo L2:55
ttgccagctttccccttctaaagggcaaaagtgagttgcgtg

SEQ ID NO: 940 - DNA, 42 bp, Artificial sequence
  Oligo L2:56
taaagcacatctgtaacttttagcaktattacgtaaaaaatc

SEQ ID NO: 941 - DNA, 42 bp, Artificial sequence
  Oligo L2:57
taaagcacatctcatacttttagcaktattacgtaaaaaatc

SEQ ID NO: 942 - DNA, 42 bp, Artificial sequence
  Oligo L2:58
gcgtgtacctaaayatacttttgctccatcgcgatgacttag

SEQ ID NO: 943 - DNA, 42 bp, Artificial sequence
  Oligo L2:59
asctgtacctaaayatacttttgctccatcgcgatgacttag

SEQ ID NO: 944 - DNA, 42 bp, Artificial sequence
  Oligo L2:60
gcgtgtacctaaccatacttttgctccatcgcgatgacttag

SEQ ID NO: 945 - DNA, 42 bp, Artificial sequence
  Oligo L2:61
asctgtacctaaccatacttttgctccatcgcgatgacttag

SEQ ID NO: 946 - DNA, 42 bp, Artificial sequence
  Oligo L2:62
ggctaagytattttctttagtttcatactgtttttctgtgah

SEQ ID NO: 947 - DNA, 42 bp, Artificial sequence
  Oligo L2:63
ggctaattgattttctttagtttcatactgtttttctgtgah

SEQ ID NO: 948 - DNA, 42 bp, Artificial sequence
  Oligo L2:64
ggctaacatattttctttagtttcatactgtttttctgtgah

SEQ ID NO: 949 - DNA, 42 bp, Artificial sequence
  Oligo L2:65
ggctaagytattttcagsagtttcatactgtttttctgtgah

SEQ ID NO: 950 - DNA, 42 bp, Artificial sequence
  Oligo L2:66
ggctaattgattttcagsagtttcatactgtttttctgtgah

SEQ ID NO: 951 - DNA, 42 bp, Artificial sequence
  Oligo L2:67
ggctaacatattttcagsagtttcatactgtttttctgtgah

SEQ ID NO: 952 - DNA, 42 bp, Artificial sequence
  Oligo L2:68
ggctaagytattttctttagtttcatactgtttttctgtcca

SEQ ID NO: 953 - DNA, 42 bp, Artificial sequence
  Oligo L2:69
ggctaattgattttctttagtttcatactgtttttctgtcca

SEQ ID NO: 954 - DNA, 42 bp, Artificial sequence
  Oligo L2:70
ggctaacatattttctttagtttcatactgtttttctgtcca

SEQ ID NO: 955 - DNA, 42 bp, Artificial sequence
  Oligo L2:71
ggctaagytattttcagsagtttcatactgtttttctgtcca

SEQ ID NO: 956 - DNA, 42 bp, Artificial sequence
  Oligo L2:72
ggctaattgattttcagsagtttcatactgtttttctgtcca

SEQ ID NO: 957 - DNA, 42 bp, Artificial sequence
  Oligo L2:73
ggctaacatattttcagsagtttcatactgtttttctgtcca

SEQ ID NO: 958 - DNA, 42 bp, Artificial sequence; identical to SEQ ID NO: 874
  Oligo L2:74

SEQ ID NO: 959 - DNA, 42 bp, Artificial sequence
  Oligo L2:75
caatacgcaacctaaagtaaaawtagccacagcactcaytgc

SEQ ID NO: 960 - DNA, 42 bp, Artificial sequence
  Oligo L2:76
caatacgcaacctaaagtaaaamcagccacagcactcaytgc

SEQ ID NO: 961 - DNA, 42 bp, Artificial sequence
  Oligo L2:77
caatacgcaacctaaagtaaaawtgcrcacagcactcaytgc

SEQ ID NO: 962 - DNA, 42 bp, Artificial sequence
  Oligo L2:78
caatacgcaacctaaagtaaaamcgcrcacagcactcaytgc

SEQ ID NO: 963 - DNA, 42 bp, Artificial sequence
  Oligo L2:79
caatacgcaacctaaagtaaaawtagccacagcttkcaytgc

SEQ ID NO: 964 - DNA, 42 bp, Artificial sequence
  Oligo L2:80
caatacgcaacctaaagtaaaamcagccacagcttkcaytgc

SEQ ID NO: 965 - DNA, 42 bp, Artificial sequence
  Oligo L2:81
caatacgcaacctaaagtaaaawtgcrcacagcttkcaytgc

SEQ ID NO: 966 - DNA, 42 bp, Artificial sequence
  Oligo L2:82
caatacgcaacctaaagtaaaamcgcrcacagcttkcaytgc

SEQ ID NO: 967 - DNA, 42 bp, Artificial sequence
  Oligo L2:83
caatacgcaacctaaagtaaaawtagccacagcactccwtgc

SEQ ID NO: 968 - DNA, 42 bp, Artificial sequence
  Oligo L2:84
caatacgcaacctaaagtaaaamcagccacagcactccwtgc

SEQ ID NO: 969 - DNA, 42 bp, Artificial sequence
  Oligo L2:85
caatacgcaacctaaagtaaaawtgcrcacagcactccwtgc

SEQ ID NO: 970 - DNA, 42 bp, Artificial sequence
  Oligo L2:86
caatacgcaacctaaagtaaaamcgcrcacagcactccwtgc

SEQ ID NO: 971 - DNA, 42 bp, Artificial sequence
  Oligo L2:87
caatacgcaacctaaagtaaaawtagccacagcttkccwtgc

SEQ ID NO: 972 - DNA, 42 bp, Artificial sequence
  Oligo L2:88
caatacgcaacctaaagtaaaamcagccacagcttkccwtgc

SEQ ID NO: 973 - DNA, 42 bp, Artificial sequence
  Oligo L2:89
caatacgcaacctaaagtaaaawtgcrcacagcttkccwtgc

SEQ ID NO: 974 - DNA, 42 bp, Artificial sequence
  Oligo L2:90
caatacgcaacctaaagtaaaamcgcrcacagcttkccwtgc

SEQ ID NO: 975 - DNA, 42 bp, Artificial sequence
  Oligo L2:91
tgtttccctttcttctttagcgacttgkctctcttgatccma

SEQ ID NO: 976 - DNA, 42 bp, Artificial sequence
  Oligo L2:92
tgtttccctttcttctttagcgacttgcakctcttgatccma

SEQ ID NO: 977 - DNA, 42 bp, Artificial sequence
  Oligo L2:93
tgtttccctttcttctttagcgacttgkctctcttgatcara

SEQ ID NO: 978 - DNA, 42 bp, Artificial sequence
  Oligo L2:94
tgtttccctttcttctttagcgacttgcakctcttgatcara

SEQ ID NO: 979 - DNA, 42 bp, Artificial sequence
  Oligo L2:95
actagcttgtcgtaataatggcggcatactakcagtagtagg

SEQ ID NO: 980 - DNA, 42 bp, Artificial sequence
  Oligo L2:96
cmaagcttgtcgtaataatggcggcatactakcagtagtagg

SEQ ID NO: 981 - DNA, 42 bp, Artificial sequence
  Oligo L2:97
tacagcttgtcgtaataatggcggcatactakcagtagtagg

SEQ ID NO: 982 - DNA, 42 bp, Artificial sequence
  Oligo L2:98
gaataagaaggctggctctgcaccttggtgatccaataattc

SEQ ID NO: 983 - DNA, 42 bp, Artificial sequence
  Oligo L2:99
gaataagaaggctggctctgcaccttggtgatctgmtaattc

SEQ ID NO: 984 - DNA, 42 bp, Artificial sequence
  Oligo L2:100
gaataagaaggctggctctgcaccttggtgatcctttaattc

SEQ ID NO: 985 - DNA, 42 bp, Artificial sequence; identical to SEQ ID NO: 881
  Oligo L2:101

SEQ ID NO: 986 - DNA, 35 bp, Artificial sequence
  Oligo L2:102
gggaacttcggcgcgccttaagacccactttcgsa

SEQ ID NO: 987 - DNA, 42 bp, Artificial sequence
  Oligo L4:01
tattggcatgtaaaaaataagcgagctctgwtggacgccwtg

SEQ ID NO: 988 - DNA, 42 bp, Artificial sequence
  Oligo L4:02
tattggcatgtaaagaataagvgcgctctgwtggacgccwtg

SEQ ID NO: 989 - DNA, 42 bp, Artificial sequence
  Oligo L4:03
gccattgagatgctcgataracacgccactcacttttgccyc

SEQ ID NO: 990 - DNA, 42 bp, Artificial sequence
  Oligo L4:04
gccattgagatgctcgatgakcacgccactcacttttgccyc

SEQ ID NO: 991 - DNA, 42 bp, Artificial sequence
  Oligo L4:05
ttagaaggggmwagctggcaagattttbttcgtaataacgca

SEQ ID NO: 992 - DNA, 42 bp, Artificial sequence
  Oligo L4:06
ttagaaggggmwagctggcaagattttbttcgtaataacart

SEQ ID NO: 993 - DNA, 42 bp, Artificial sequence
  Oligo L4:07
ttagaaggggmwagctggagggattttbttcgtaataacgca

SEQ ID NO: 994 - DNA, 42 bp, Artificial sequence
  Oligo L4:08
ttagaaggggmwagctggagggattttbttcgtaataacart

SEQ ID NO: 995 - DNA, 42 bp, Artificial sequence
  Oligo L4:09
ttagaaggggmwagctgggmtgattttbttcgtaataacgca

SEQ ID NO: 996 - DNA, 42 bp, Artificial sequence
  Oligo L4:10
ttagaaggggmwagctgggmtgattttbttcgtaataacart

SEQ ID NO: 997 - DNA, 42 bp, Artificial sequence
  Oligo L4:11
aaaartatgagahgtgctttactaagtyaccgcgatgsagca

SEQ ID NO: 998 - DNA, 42 bp, Artificial sequence
  Oligo L4:12
aaagsaatgagahgtgctttactaagtyaccgcgatgsagca

SEQ ID NO: 999 - DNA, 42 bp, Artificial sequence
  Oligo L4:13
aragtatgctccrggacaggatttacagaaaaacaakttgaa

SEQ ID NO: 1000 - DNA, 42 bp, Artificial sequence
  Oligo L4:14
aragtatgctccrggacaggatttacagaaaaacaatacgaa

SEQ ID NO: 1001 - DNA, 42 bp, Artificial sequence
  Oligo L4:15
aragtatgctccrggacaggatttacagaaaaamatkttgaa

SEQ ID NO: 1002 - DNA, 42 bp, Artificial sequence
  Oligo L4:16
aragtatgctccrggacaggatttacagaaaaamattacgaa

SEQ ID NO: 1003 - DNA, 42 bp, Artificial sequence
  Oligo L4:17
aragtatgcmtcrggacaggatttacagaaaaacaakttgaa

SEQ ID NO: 1004 - DNA, 42 bp, Artificial sequence
  Oligo L4:18
aragtatgcmtcrggacaggatttacagaaaaacaatacgaa

SEQ ID NO: 1005 - DNA, 42 bp, Artificial sequence
  Oligo L4:19
aragtatgcmtcrggacaggatttacagaaaaamatkttgaa

SEQ ID NO: 1006 - DNA, 42 bp, Artificial sequence
  Oligo L4:20
aragtatgcmtcrggacaggatttacagaaaaamattacgaa

SEQ ID NO: 1007 - DNA, 42 bp, Artificial sequence
  Oligo L4:21
actgctgamaattcavttgcctttmtgtgccaacaaggtttk

SEQ ID NO: 1008 - DNA, 42 bp, Artificial sequence
  Oligo L4:22
actgctgamaattcavttgccttttactgccaacaaggtttk

SEQ ID NO: 1009 - DNA, 42 bp, Artificial sequence
  Oligo L4:23
actgctaggaattcavttgcctttmtgtgccaacaaggtttk

SEQ ID NO: 1010 - DNA, 42 bp, Artificial sequence
  Oligo L4:24
actgctaggaattcavttgccttttactgccaacaaggtttk

SEQ ID NO: 1011 - DNA, 42 bp, Artificial sequence
  Oligo L4:25
tcactagagvacgsattatatgcaatgcaagctgcatgtatt

SEQ ID NO: 1012 - DNA, 42 bp, Artificial sequence
  Oligo L4:26
tcactagagvacgsattatatgcaatgcaagctvtctgtatt

SEQ ID NO: 1013 - DNA, 42 bp, Artificial sequence
  Oligo L4:27
tcactagagsaagsattatatgcaatgcaagctgcatgtatt

SEQ ID NO: 1014 - DNA, 42 bp, Artificial sequence
  Oligo L4:28
tcactagagsaagsattatatgcaatgcaagctvtctgtatt

SEQ ID NO: 1015 - DNA, 42 bp, Artificial sequence
  Oligo L4:29
twcactttaggttgcgyattgctcgatcaagagttgcaagtc

SEQ ID NO: 1016 - DNA, 42 bp, Artificial sequence
  Oligo L4:30
twcactttaggttgcgyattgctcgatcgtgagttgcaagtc

SEQ ID NO: 1017 - DNA, 42 bp, Artificial sequence
  Oligo L4:31
gctaaagaagaaagggaaacacctcaaactgatagtatgyct

SEQ ID NO: 1018 - DNA, 42 bp, Artificial sequence
  Oligo L4:32
gctaaagaagaaagggaaacacctactactgatagtatgyct

SEQ ID NO: 1019 - DNA, 42 bp, Artificial sequence
  Oligo L4:33
ccattawtkcgacaagctttgaatttaaaggatcaccaargc

SEQ ID NO: 1020 - DNA, 42 bp, Artificial sequence
  Oligo L4:34
ccattawtkcgacaagctttggawttaaaggatcaccaargc

SEQ ID NO: 1021 - DNA, 42 bp, Artificial sequence
  Oligo L4:35
gcagrwccagccttcttattcgkgvttgaattgvtkatatgc

SEQ ID NO: 1022 - DNA, 39 bp, Artificial sequence
  Oligo L4:36
ggahttgaaaaacaacttaaatgtgaaagtgggtcttaa

SEQ ID NO: 1023 - DNA, 39 bp, Artificial sequence
  Oligo L4:37
ggagctgaaaaacaacttaaatgtgaaagtgggtcttaa

SEQ ID NO: 1024 - DNA, 42 bp, Artificial sequence
  Oligo L4:38
tytatcgagcatctcaatggccawggcgtccawcagagctcg

SEQ ID NO: 1025 - DNA, 42 bp, Artificial sequence
  Oligo L4:39
mtcatcgagcatctcaatggccawggcgtccawcagagctcg

SEQ ID NO: 1026 - DNA, 42 bp, Artificial sequence
  Oligo L4:40
tytatcgagcatctcaatggccawggcgtccawcagagcgcb

SEQ ID NO: 1027 - DNA, 42 bp, Artificial sequence
  Oligo L4:41
mtcatcgagcatctcaatggccawggcgtccawcagagcgcb

SEQ ID NO: 1028 - DNA, 42 bp, Artificial sequence
  Oligo L4:42
ttgccagctwkccccttctaagrggcaaaagtgagtggcgtg

SEQ ID NO: 1029 - DNA, 42 bp, Artificial sequence
  Oligo L4:43
cctccagctwkccccttctaagrggcaaaagtgagtggcgtg

SEQ ID NO: 1030 - DNA, 42 bp, Artificial sequence
  Oligo L4:44
akcccagctwkccccttctaagrggcaaaagtgagtggcgtg

SEQ ID NO: 1031 - DNA, 42 bp, Artificial sequence
  Oligo L4:45
taaagcacdtctcataytttttgcgttattacgaavaaaatc

SEQ ID NO: 1032 - DNA, 42 bp, Artificial sequence
  Oligo L4:46
taaagcacdtctcattscttttgcgttattacgaavaaaatc

SEQ ID NO: 1033 - DNA, 42 bp, Artificial sequence
  Oligo L4:47
taaagcacdtctcatayttttaytgttattacgaavaaaatc

SEQ ID NO: 1034 - DNA, 42 bp, Artificial sequence
  Oligo L4:48
taaagcacdtctcattsctttaytgttattacgaavaaaatc

SEQ ID NO: 1035 - DNA, 42 bp, Artificial sequence
  Oligo L4:49
tcctgtccyggagcatactyttgctscatcgcggtracttag

SEQ ID NO: 1036 - DNA, 42 bp, Artificial sequence
  Oligo L4:50
tcctgtccygakgcatactyttgctscatcgcggtracttag

SEQ ID NO: 1037 - DNA, 42 bp, Artificial sequence
  Oligo L4:51
ggcaabtgaattktcagcagtttcaamttgtttttctgtaaa

SEQ ID NO: 1038 - DNA, 42 bp, Artificial sequence
  Oligo L4:52
ggcaabtgaattcctagcagtttcaamttgtttttctgtaaa

SEQ ID NO: 1039 - DNA, 42 bp, Artificial sequence
  Oligo L4:53
ggcaabtgaattktcagcagtttcgtattgtttttctgtaaa

SEQ ID NO: 1040 - DNA, 42 bp, Artificial sequence
  Oligo L4:54
ggcaabtgaattcctagcagtttcgtattgtttttctgtaaa

SEQ ID NO: 1041 - DNA, 42 bp, Artificial sequence
  Oligo L4:55
ggcaabtgaattktcagcagtttcaamatktttttctgtaaa

SEQ ID NO: 1042 - DNA, 42 bp, Artificial sequence
  Oligo L4:56
ggcaabtgaattcctagcagtttcaamatktttttctgtaaa

SEQ ID NO: 1043 - DNA, 42 bp, Artificial sequence
  Oligo L4:57
ggcaabtgaattktcagcagtttcgtaatktttttctgtaaa

SEQ ID NO: 1044 - DNA, 42 bp, Artificial sequence
  Oligo L4:58
ggcaabtgaattcctagcagtttcgtaatktttttctgtaaa

SEQ ID NO: 1045 - DNA, 42 bp, Artificial sequence
  Oligo L4:59
atataatscgtbctctagtgamaaaccttgttggcacakaaa

SEQ ID NO: 1046 - DNA, 42 bp, Artificial sequence
  Oligo L4:60
atataatscttsctctagtgamaaaccttgttggcacakaaa

SEQ ID NO: 1047 - DNA, 42 bp, Artificial sequence
  Oligo L4:61
atataatscgtbctctagtgamaaaccttgttggcagtaaaa

SEQ ID NO: 1048 - DNA, 42 bp, Artificial sequence
  Oligo L4:62
atataatscttsctctagtgamaaaccttgttggcagtaaaa

SEQ ID NO: 1049 - DNA, 42 bp, Artificial sequence
  Oligo L4:63
caatrcgcaacctaaagtgwaaatacatgcagcttgcattgc

SEQ ID NO: 1050 - DNA, 42 bp, Artificial sequence
  Oligo L4:64
caatrcgcaacctaaagtgwaaatacagabagcttgcattgc

SEQ ID NO: 1051 - DNA, 42 bp, Artificial sequence
  Oligo L4:65
tgtttccctttcttctttagcgacttgcaactcttgatcgag

SEQ ID NO: 1052 - DNA, 42 bp, Artificial sequence
  Oligo L4:66
tgtttccctttcttctttagcgacttgcaactcacgatcgag

SEQ ID NO: 1053 - DNA, 42 bp, Artificial sequence
  Oligo L4:67
caaagcttgtcgmawtaatggagrcatactatcagtttgagg

SEQ ID NO: 1054 - DNA, 42 bp, Artificial sequence
  Oligo L4:68
caaagcttgtcgmawtaatggagrcatactatcagtagtagg

SEQ ID NO: 1055 - DNA, 42 bp, Artificial sequence
  Oligo L4:69
gaataagaaggctggwyctgcgcyttggtgatcctttaaatt

SEQ ID NO: 1056 - DNA, 42 bp, Artificial sequence
  Oligo L4:70
gaataagaaggctggwyctgcgcyttggtgatcctttaawtc

SEQ ID NO: 1057 - DNA, 42 bp, Artificial sequence
  Oligo L4:71
tttaagttgtttttcaadtccgcatatmabcaattcaabcmc

SEQ ID NO: 1058 - DNA, 42 bp, Artificial sequence
  Oligo L4:72
tttaagttgtttttcagctccgcatatmabcaattcaabcmc

SEQ ID NO: 1059 - DNA, 35 bp, Artificial sequence; identical to SEQ ID NO: 882
  Oligo L1:50 Table 12

SEQ ID NO: 1060 - DNA, 42 bp, Artificial sequence
  Oligo L1-9:01
tattggcatgtaaagaataagcgtgctctgttggacgccctg

SEQ ID NO: 1061 - DNA, 42 bp, Artificial sequence
  Oligo L1-9:02
gccattgagatgctcgatcgtcacgccactcacttttgccct

SEQ ID NO: 1062 - DNA, 42 bp, Artificial sequence
  Oligo L1-9:03
ttagaaggggaaagctggcaagattttctccgtaataatgca

SEQ ID NO: 1063 - DNA, 42 bp, Artificial sequence
  oligo L1-9:04
aaatcaatgagatgcgctttactaagtcatcgcgatggggca

SEQ ID NO: 1064 - DNA, 42 bp, Artificial sequence
  Oligo L1-9:05
aaggtatgtcttggtacaggattcacagaaaaacagtacgaa

SEQ ID NO: 1065 - DNA, 42 bp, Artificial sequence
  Oligo L1-9:06
actgctgaaaatagtttggcctttctgtgccaacaaggtttc

SEQ ID NO: 1066 - DNA, 42 bp, Artificial sequence
  Oligo L1-9:07
tcactagagaatgctttatatgcaatgcaagctgtctgtatc

SEQ ID NO: 1067 - DNA, 42 bp, Artificial sequence
  Oligo L1-9:08
ttcactttaggttgcgttttgctggatcaagagctccaagtc

SEQ ID NO: 1068 - DNA, 42 bp, Artificial sequence
  Oligo L1-9:09
gctaaagaagaaagggaaacacctactactgatagtatgccc

SEQ ID NO: 1069 - DNA, 42 bp, Artificial sequence
  Oligo L1-9:10
ccattattgcgacaagctttggaattaaaagatcaccaaggg

SEQ ID NO: 1070 - DNA, 42 bp, Artificial sequence
  Oligo L1-9:11
gcagagccagccttcttattcggattggaattgataatatgc

SEQ ID NO: 1071 - DNA, 39 bp, Artificial sequence
  Oligo L1-9:12
ggattggaaaaacaacttaaatgtgaaagtgggtcttaa

SEQ ID NO: 1072 - DNA, 42 bp, Artificial sequence
  Oligo L1-9:13
acgatcgagcatctcaatggccagggcgtccaacagagcacg

SEQ ID NO: 1073 - DNA, 42 bp, Artificial sequence
  Oligo L1-9:14
ttgccagctttccccttctaaagggcaaaagtgagtggcgtg

SEQ ID NO: 1074 - DNA, 42 bp, Artificial sequence
  Oligo L1-9:15
taaagcgcatctcattgattttgcattattacggagaaaatc

SEQ ID NO: 1075 - DNA, 42 bp, Artificial sequence
  Oligo L1-9:16
tcctgtaccaagacatacctttgccccatcgcgatgacttag

SEQ ID NO: 1076 - DNA, 42 bp, Artificial sequence
  Oligo L1-9:17
ggccaaactattttcagcagtttcgtactgtttttctgtgaa

SEQ ID NO: 1077 - DNA, 42 bp, Artificial sequence
  Oligo L1-9:18
atataaagcattctctagtgagaaaccttgttggcacagaaa

SEQ ID NO: 1078 - DNA, 42 bp, Artificial sequence
  Oligo L1-9:19
caaaacgcaacctaaagtgaagatacagacagcttgcattgc

SEQ ID NO: 1079 - DNA, 42 bp, Artificial sequence
  Oligo L1-9:20
tgtttccctttcttctttagcgacttggagctcttgatccag

SEQ ID NO: 1080 - DNA, 42 bp, Artificial sequence
  Oligo L1-9:21
caaagcttgtcgcaataatgggggcatactatcagtagtagg

SEQ ID NO: 1081 - DNA, 42 bp, Artificial sequence
  Oligo L1-9:22
gaataagaaggctggctctgccccttggtgatcttttaattc

SEQ ID NO: 1082 - DNA, 42 bp, Artificial sequence
  Oligo L1-9:23
tttaagttgtttttccaatccgcatattatcaattccaatcc

SEQ ID NO: 1083 - DNA, 35 bp, Artificial sequence; identical to SEQ ID NO: 882
  Oligo L1-9:24

SEQ ID NO: 1084 - DNA, 42 bp, Artificial sequence; identical to SEQ ID NO: 833
  Oligo L6:1

SEQ ID NO: 1085 - DNA, 42 bp, Artificial sequence; identical to SEQ ID NO: 857
  Oligo L6:2

SEQ ID NO: 1086 - DNA, 42 bp, Artificial sequence; identical to SEQ ID NO: 874
  Oligo L6:3

SEQ ID NO: 1087 - DNA, 42 bp, Artificial sequence; identical to SEQ ID NO: 881
  Oligo L6:4

SEQ ID NO: 1088 - DNA, 42 bp, Artificial sequence; identical to SEQ ID NO: 888
  Oligo L6:5

SEQ ID NO: 1089 - DNA, 42 bp, Artificial sequence; identical to SEQ ID NO: 941
  Oligo L6:6

SEQ ID NO: 1090 - DNA, 42 bp, Artificial sequence
  Oligo L6:7
ttgccagctttccccttctaaagggcamahgtgagttgcgtg

SEQ ID NO: 1091 - DNA, 42 bp, Artificial sequence
  Oligo L6:8
ttgccagctttccccttctaaagggcaatagtgagttgcgtg

SEQ ID NO: 1092 - DNA, 42 bp, Artificial sequence; identical to SEQ ID NO: 984
  Oligo L6:9

SEQ ID NO: 1093 - DNA, 42 bp, Artificial sequence
  Oligo L6:10
gccattgagatgatggataggcacgcaactcactattgccct

SEQ ID NO: 1094 - DNA, 42 bp, Artificial sequence
  Oligo L6:11
rstgctgaaaatatgttagcctttttatgccaacaaggtttt

SEQ ID NO: 1095 - DNA, 42 bp, Artificial sequence
  Oligo L6:12
tttactttaggttgcgtattgtttgatcaagagctccaagtc

SEQ ID NO: 1096 - DNA, 42 bp, Artificial sequence
  Oligo L6:13
tgtttccctttcttctttagcgacttggagctcttgatcaaa

SEQ ID NO: 1097 - DNA, 42 bp, Artificial sequence
  Oligo L6:14
gccattgagatgatggataggcacgcaactcacdtktgccct

SEQ ID NO: 1098 - DNA, 42 bp, Artificial sequence
  Oligo L6:15
gccattgagatgatggataggcaccaaactcacdtktgccct

SEQ ID NO: 1099 - DNA, 42 bp, Artificial sequence
  Oligo L6:16
gccattgagatgatggataggcaccaaactcactattgccct

SEQ ID NO: 1100 - DNA, 42 bp, Artificial sequence
  Oligo L6:17
aaaagtatgagatgtgctttactaagccatcgcgatggagca

SEQ ID NO: 1101 - DNA, 42 bp, Artificial sequence
  Oligo L6:18
aaagtatgkttaggtacacgctggacagaamaacawtatgaa

SEQ ID NO: 1102 - DNA, 42 bp, Artificial sequence
  Oligo L6:19
aaagtatgkttaggtacacgctggacagaamaawtgtatgaa

SEQ ID NO: 1103 - DNA, 42 bp, Artificial sequence
  Oligo L6:20
rstgctgaaaatcaattagcctttttatgccaacaaggtttt

SEQ ID NO: 1104 - DNA, 42 bp, Artificial sequence
  Oligo L6:21
tcactagagaatgcattatatgcartgagtgcgtggrgggtg

SEQ ID NO: 1105 - DNA, 42 bp, Artificial sequence
  Oligo L6:22
tcactagagaatgcattatatgcartgagtgcgtggrggaac

SEQ ID NO: 1106 - DNA, 42 bp, Artificial sequence
  Oligo L6:23
tttactttaggttgcgtattgtttgatcaagagagccaagtc

SEQ ID NO: 1107 - DNA, 42 bp, Artificial sequence
  Oligo L6:24
gctaaagaagaaagggaaacacctactactgctagtatgccg

SEQ ID NO: 1108 - DNA, 42 bp, Artificial sequence
  Oligo L6:25
ccattaktgcgacaagbttkggaattaaaggatcaccaaggt

SEQ ID NO: 1109 - DNA, 42 bp, Artificial sequence
  Oligo L6:26
ccattagcccgacaagbttkggaattaaaggatcaccaaggt

SEQ ID NO: 1110 - DNA, 39 bp, Artificial sequence
  Oligo L6:27
ggattagaaaaacaacttaaatgcgaaagtgggtcttaa

SEQ ID NO: 1111 - DNA, 42 bp, Artificial sequence
  Oligo L6:28
cctatccatcatctcaatggctaaggcgtcgagcagagctcg

SEQ ID NO: 1112 - DNA, 42 bp, Artificial sequence
  Oligo L6:29
ttgccagctttccccttctaaagggcamahgtgagtttggtg

SEQ ID NO: 1113 - DNA, 42 bp, Artificial sequence
  Oligo L6:30
ttgccagctttccccttctaaagggcaatagtgagtttggtg

SEQ ID NO: 1114 - DNA, 42 bp, Artificial sequence
  Oligo L6:31
gcgtgtacctaamcatacttttgctccatcgcgatggcttag

SEQ ID NO: 1115 - DNA, 42 bp, Artificial sequence
  Oligo L6:32
ggctaacatattttcagcasyttcatawtgttkttctgtcca

SEQ ID NO: 1116 - DNA, 42 bp, Artificial sequence
  Oligo L6:33
ggctaattgattttcagcasyttcatawtgttkttctgtcca

SEQ ID NO: 1117 - DNA, 42 bp, Artificial sequence
  Oligo L6:34
ggctaacatattttcagcasyttcatacawttkttctgtcca

SEQ ID NO: 1118 - DNA, 42 bp, Artificial sequence
  Oligo L6:35
ggctaattgattttcagcasyttcatacawttkttctgtcca

SEQ ID NO: 1119 - DNA, 42 bp, Artificial sequence
  Oligo L6:36
caatacgcaacctaaagtaaacacccycacagcactcaytgc

SEQ ID NO: 1120 - DNA, 42 bp, Artificial sequence
  Oligo L6:37
caatacgcaacctaaagtaaagttccycacagcactcaytgc

SEQ ID NO: 1121 - DNA, 42 bp, Artificial sequence
  Oligo L6:38
tgtttccctttcttctttagcgacttggctctcttgatcaaa

SEQ ID NO: 1122 - DNA, 42 bp, Artificial sequence
  Oligo L6:39
cmaavcttgtcgcamtaatggcggcatactagcagtagtagg

SEQ ID NO: 1123 - DNA, 42 bp, Artificial sequence
  Oligo L6:40
cmaavcttgtcgggctaatggcggcatactagcagtagtagg

SEQ ID NO: 1124 - DNA, 35 bp, Artificial sequence
  Oligo L6:41
gggaacttcggcgcgccttaagacccactttcgca

SEQ ID NO: 1125 - DNA, 42 bp, Artificial sequence
  Oligo L7:01
tattggcatgtaaaaaataagcgagctctgctcgacgcawtg

SEQ ID NO: 1126 - DNA, 42 bp, Artificial sequence
  Oligo L7:02
gccattgagatgctggataggcacgcgactcacdtstgccct

SEQ ID NO: 1127 - DNA, 42 bp, Artificial sequence
  Oligo L7:03
gccattgagatgctggataggcacgcgactcactattgccct

SEQ ID NO: 1128 - DNA, 42 bp, Artificial sequence; identical to SEQ ID NO: 843
  Oligo L7:04

SEQ ID NO: 1129 - DNA, 42 bp, Artificial sequence; identical to SEQ ID NO: 847
  Oligo L7:05

SEQ ID NO: 1130 - DNA, 42 bp, Artificial sequence
  Oligo L7:06
aaagtatgtttaggtacaggctttacagaamagmtgtatgaa

SEQ ID NO: 1131 - DNA, 42 bp, Artificial sequence
  Oligo L7:07
aaagtatgtttaggtacaggctttacagaamagcamtatgaa

SEQ ID NO: 1132 - DNA, 42 bp, artificial sequence
  Oligo L7:08
rstgccgaaaatagtmtggcctttttatgccaacaaggtttt

SEQ ID NO: 1133 - DNA, 42 bp, Artificial sequence
  Oligo L7:09
tcactagagmacgcamtgtatgcaatgcaggctgytkgtatt

SEQ ID NO: 1134 - DNA, 42 bp, Artificial sequence
  Oligo L7:10
twtactttaggttgcgtattgttggatcaagagcttcaagtc

SEQ ID NO: 1135 - DNA, 42 bp, Artificial sequence; identical to SEQ ID NO: 855
  Oligo L7:11

SEQ ID NO: 1136 - DNA, 42 bp, Artificial sequence
  Oligo L7:12
ccattagctcgacaagbtctggaattaaaggatcaccaaggt

SEQ ID NO: 1137 - DNA, 42 bp, Artificial sequence
  Oligo L7:13
ccattastccgacaagbtctggaattaaaggatcaccaaggt

SEQ ID NO: 1138 - DNA, 42 bp, Artificial sequence; identical to SEQ ID NO: 857
  Oligo L7:14

SEQ ID NO: 1139 - DNA, 39 bp, Artificial sequence
  Oligo L7:15
ggattagaaaaacaacttaaatgtgaaagtgggtcttaa

SEQ ID NO: 1140 - DNA, 42 bp, Artificial sequence
  Oligo L7:16
cctatccagcatctcaatggccawtgcgtcgagcagagctcg

SEQ ID NO: 1141 - DNA, 42 bp, Artificial sequence
  Oligo L7:17
ttgccagctttccccttctaaagggcasahgtgagtcgcgtg

SEQ ID NO: 1142 - DNA, 42 bp, Artificial sequence
  Oligo L7:18
ttgccagctttccccttctaaagggcaatagtgagtcgcgtg

SEQ ID NO: 1143 - DNA, 42 bp, Artificial sequence; identical to SEQ ID NO: 867
  Oligo L7:19

SEQ ID NO: 1144 - DNA, 42 bp, Artificial sequence
  Oligo L7:20
gcctgtacctaaacatacttttgctccatcgcgatgacttag

SEQ ID NO: 1145 - DNA, 42 bp, Artificial sequence
  Oligo L7:21
ggccakactattttcggcasyttcatacakctkttctgtaaa

SEQ ID NO: 1146 - DNA, 42 bp, Artificial sequence
  Oligo L7:22
ggccakactattttcggcasyttcataktgctkttctgtaaa

SEQ ID NO: 1147 - DNA, 42 bp, Artificial sequence
  Oligo L7:23
atacaktgcgtkctctagtgaaaaaccttgttggcataaaaa

SEQ ID NO: 1148 - DNA, 42 bp, Artificial sequence
  Oligo L7:24
caatacgcaacctaaagtawaaatacmarcagcctgcattgc

SEQ ID NO: 1149 - DNA, 42 bp, Artificial sequence
  Oligo L7:25
tgtttccctttcttctttagcgacttgaagctcttgatccaa

SEQ ID NO: 1150 - DNA, 42 bp, Artificial sequence
  Oligo L7:26
cagavcttgtcgagctaatggcggcatactatcagtagtagg

SEQ ID NO: 1151 - DNA, 42 bp, Artificial sequence
  Oligo L7:27
cagavcttgtcggastaatggcggcatactatcagtagtagg

SEQ ID NO: 1152 - DNA, 42 bp, Artificial sequence; identical to SEQ ID NO: 984
  Oligo L7:28

SEQ ID NO: 1153 - DNA, 42 bp, Artificial sequence; identical to SEQ ID NO: 881
  Oligo L7:29

SEQ ID NO: 1154 - DNA, 35 bp, Artificial sequence; identical to SEQ ID NO: 882
  Oligo L7:30

SEQ ID NO: 1155 - DNA, 48 bp, Artificial sequence
  Oligo tetO1
cctaatttttgttgacactctatcattgatagagttattttaccactc

SEQ ID NO: 1156 - DNA, 48 bp, Artificial sequence
  Oligo tetO2
ggattaaaaacaactgtgagatagtaactatctcaataaaatggtgag

SEQ ID NO: 1157 - DNA, 48 bp, Artificial sequence
  Oligo control
cctaatttttgttgactgtgttagtccatagctggtattttaccactc

SEQ ID NO: 1158 - DNA, 48 bp, Artificial sequence
  Oligo Control Complement
ggattaaaaacaactgacacaatcaggtatcgaccataaaatggtgag

SEQ ID NO: 1159 - DNA, 42 bp, Artificial sequence
  Oligo L13:1
tggcacgtcaagaacaagcgagctctgctagacgctatggcc

SEQ ID NO: 1160 - DNA, 42 bp, Artificial sequence
  Oligo L13:2
attgagatgttsgataggcacaagacccactactgtcctttg

SEQ ID NO: 1161 - DNA, 42 bp, Artificial sequence
  Oligo L13:3
attgagatgttsgataggcacaagacccactacctgcctttg

SEQ ID NO: 1162 - DNA, 42 bp, Artificial sequence
  Oligo L13:4
attgagatgttsgataggcacgmcacccactactgtcctttg

SEQ ID NO: 1163 - DNA, 42 bp, Artificial sequence
  Oligo L13:5
attgagatgttsgataggcacgmcacccactacctgcctttg

SEQ ID NO: 1164 - DNA, 42 bp, Artificial sequence
  Oligo L13:6
gaaggggaaagctggcaagacttcttgaggaacaatgctaag

SEQ ID NO: 1165 - DNA, 42 bp, Artificial sequence
  Oligo L13:7
gaaggggaaagctggcaagacttcttgaggaacarggctaag

SEQ ID NO: 1166 - DNA, 42 bp, Artificial sequence
  Oligo L13:8
tccakgagaaatgctttgctcagtcaccgtgatggagccaag

SEQ ID NO: 1167 - DNA, 42 bp, Artificial sequence
  Oligo L13:9
gtctgcctaggtacgggcttcacggagcaacagtatgaaact

SEQ ID NO: 1168 - DNA, 42 bp, Artificial sequence
  Oligo L13:10
gtcgctctaggtacgggcttcacggagcaacagtatgaaact

SEQ ID NO: 1169 - DNA, 42 bp, Artificial sequence
  Oligo L13:11
gctgagaactskcttgccttcctgacacaacaaggtttctcc

SEQ ID NO: 1170 - DNA, 42 bp, Artificial sequence
  Oligo L13:12
atggagaactskcttgccttcctgacacaacaaggtttctcc

SEQ ID NO: 1171 - DNA, 42 bp, Artificial sequence
  Oligo L13:13
cttgagaacgccctctacgcatttcaagctgttgggatctac

SEQ ID NO: 1172 - DNA, 42 bp, Artificial sequence
  Oligo L13:14
cttgagaacgccctctacgcaggtcaagctgttgggatctac

SEQ ID NO: 1173 - DNA, 42 bp, Artificial sequence
  Oligo L13:15
cttgagaacgccctctacgcaatgcaagctgttgggatctac

SEQ ID NO: 1174 - DNA, 42 bp, Artificial sequence
  Oligo L13:16
actctgggttgcgtcttgctggatcaagagctgcaagtcgct

SEQ ID NO: 1175 - DNA, 42 bp, Artificial sequence
  Oligo L13:17
aaggaggagagggaaacacctactactgatagtatgccgcca

SEQ ID NO: 1176 - DNA, 42 bp, Artificial sequence
  Oligo L13:18
ctggttcgacaagcttacgaactccacgatcaccaaggtgca

SEQ ID NO: 1177 - DNA, 42 bp, Artificial sequence
  Oligo L13:19
ctggttcgacaagcttacgaactcaragatcaccaaggtgca

SEQ ID NO: 1178 - DNA, 42 bp, Artificial sequence
  Oligo L13:20
ctggttcgacaagcthtcgaactccacgatcaccaaggtgca

SEQ ID NO: 1179 - DNA, 42 bp, Artificial sequence
  Oligo L13:21
ctggttcgacaagcthtcgaactcaragatcaccaaggtgca

SEQ ID NO: 1180 - DNA, 42 bp, Artificial sequence
  Oligo L13:22
gagccagccttcctgttcggccttgaactgatcatawgtgga

SEQ ID NO: 1181 - DNA, 42 bp, Artificial sequence
  oligo L13:23
ttggagaagcagctgaagtgtgaaagtgggtcttaatgatag

SEQ ID NO: 1182 - DNA, 42 bp, Artificial sequence
  Oligo L13:24
ttggagaagcagctgaaggcagaaagtgggtcttaatgatag

SEQ ID NO: 1183 - DNA, 42 bp, Artificial sequence
  Oligo L13:25
gtgcctatcsaacatctcaatggccatagcgtctagcagagc

SEQ ID NO: 1184 - DNA, 42 bp, Artificial sequence
  Oligo L13:26
gtcttgccagctttccccttccaaaggacagtagtgggtctt

SEQ ID NO: 1185 - DNA, 42 bp, Artificial sequence
  Oligo L13:27
gtcttgccagctttccccttccaaaggcaggtagtgggtctt

SEQ ID NO: 1186 - DNA, 42 bp, Artificial sequence
  Oligo L13:28
gtcttgccagctttccccttccaaaggacagtagtgggtgkc

SEQ ID NO: 1187 - DNA, 42 bp, Artificial sequence
  Oligo L13:29
gtcttgccagctttccccttccaaaggcaggtagtgggtgkc

SEQ ID NO: 1188 - DNA, 42 bp, Artificial sequence
  Oligo L13:30
gagcaaagcatttctcmtggacttagcattgttcctcaagaa

SEQ ID NO: 1189 - DNA, 42 bp, Artificial sequence
  Oligo L13:31
gagcaaagcatttctcmtggacttagccytgttcctcaagaa

SEQ ID NO: 1190 - DNA, 42 bp, Artificial sequence
  Oligo L13:32
gaagcccgtacctaggcagaccttggctccatcacggtgact

SEQ ID NO: 1191 - DNA, 42 bp, Artificial sequence
  Oligo L13:33
gaagcccgtacctagagcgaccttggctccatcacggtgact

SEQ ID NO: 1192 - DNA, 42 bp, Artificial sequence
  Oligo L13:34
gaaggcaagmsagttctcagcagtttcatactgttgctccgt

SEQ ID NO: 1193 - DNA, 42 bp, Artificial sequence
  Oligo L13:35
gaaggcaagmsagttctccatagtttcatactgttgctccgt

SEQ ID NO: 1194 - DNA, 42 bp, Artificial sequence
  Oligo L13:36
tgcgtagagggcgttctcaagggagaaaccttgttgtgtcag

SEQ ID NO: 1195 - DNA, 42 bp, Artificial sequence
  Oligo L13:37
cagcaagacgcaacccagagtgtagatcccaacagcttgaaa

SEQ ID NO: 1196 - DNA, 42 bp, Artificial sequence
  Oligo L13:38
cagcaagacgcaacccagagtgtagatcccaacagcttgacc

SEQ ID NO: 1197 - DNA, 42 bp, Artificial sequence
  Oligo L13:39
cagcaagacgcaacccagagtgtagatcccaacagcttgcat

SEQ ID NO: 1198 - DNA, 42 bp, Artificial sequence
  Oligo L13:40
aggtgtttccctctcctccttagcgacttgcagctcttgatc

SEQ ID NO: 1199 - DNA, 42 bp, Artificial sequence
  Oligo L13:41
ttcgtaagcttgtcgaaccagtggcggcatactatcagtagt

SEQ ID NO: 1200 - DNA, 42 bp, Artificial sequence
  oligo L13:42
ttcgadagcttgtcgaaccagtggcggcatactatcagtagt

SEQ ID NO: 1201 - DNA, 42 bp, Artificial sequence
  Oligo L13:43
gccgaacaggaaggctggctctgcaccttggtgatcgtggag

SEQ ID NO: 1202 - DNA, 42 bp, Artificial sequence
  Oligo L13:44
gccgaacaggaaggctggctctgcaccttggtgatctytgag

SEQ ID NO: 1203 - DNA, 42 bp, Artificial sequence
  Oligo L13:45
acacttcagctgcttctccaatccacwtatgatcagttcaag

SEQ ID NO: 1204 - DNA, 42 bp, Artificial sequence
  Oligo L13:46
tgccttcagctgcttctccaatccacwtatgatcagttcaag

SEQ ID NO: 1205 - DNA, 42 bp, Artificial sequence
  Oligo L13:47
gcgccaaggtaccttctgcagctatcattaagacccactttc

SEQ ID NO: 1206 - protein, 208 aa, Artificial Sequence
  rSuR L1-18
MGSRLDKSKVINSALELLNEVGIEGLTTRKLAQKLGVEQPTLYWHVKNKRALLDALAIEMLDRHLTHFCPLEGESWQDFLRNNAKSMRCALLSHRDGAKVWLGTGFTEKQYETKENRLAFLCQQGFSLENALYAIRAVSRFTLGCVLQDQEPQVAKEERETPTTDSMPPLLRQAVELFDHQGAEPAFLFGLELIICGLEKQLKCESES

SEQ ID NO: 1207 - protein, 208 aa, Artificial sequence
  rSuR L1-21
MGSRLDKSKVINSALELLNEVGIEGLTTRKLAQKLGVEQPTLYWHVKNKRALLDALAIEMLDRHATHFCPLEGESWQDFLRNNAKSFRCALLSHRDGAKVCLGTAGTEKQYETLENCLAFLCQQGFSLENALYARSAVVCFTLGCVLFDQEMQVAKEERETPTTDSMPPLLRQAAELLDHQGAEPAFLFGLELIICGLEKQLKCESGS

SEQ ID NO: 1208 - protein, 208 aa, Artificial sequence
  rSuR L1-25
MGSRLDKSKVINSALELLNEVGIEGLTTRKLAQKLGVEQPTLYWHVKNKRALLDALAIEMLDRHATHFCPLEGESWQDFLRNTAKSMRCALLSHRDGAKVLLGTATTEKQYETLENLLAFLYQQGFSLENALYAWQAVWRFTLGCVLIDQETQVAKEERETPTTDSMPPLLRQAVELKDHQGAEPAFLFGLELIICGLEKQLKCETGS

SEQ ID NO: 1209 - protein, 208 aa, Artificial sequence
  rSuR L1-33
MGSRLDKSKVINSALELLNEVGIEGLTTRKLAQKLGVEQPTLYWHVKNKRALLDALAIEMLDRHATHFCPLEGESWQDFLRNNAKSMRCALLSHRDGAKVQLGTAATEKQYETLENKLAFLCQQGFSLENALYAHSAVTQFTLGCVLRDQEGQVAKEERETPTTDSMPPLLRQARELRDHQGAEPAFLFGLELIICGLEKQLKCESGS

SEQ ID NO: 1210 - protein, 208 aa, Artificial sequence
  rSuR L1-34
MGSRLDKSKVINSALELLNEVGIEGLTTRKLAQKLGVEQPTLYWHVKNKRALLDALAIEMADRHNTHFCPLEGESWQDFLRNAARSMRCALLSHRDGAKVYLGTARTEKQYETTENVLAFLCQQGFSLENALYAVRAVPRFTLGCVLLDQERQVAKEERETPTTDSMPPLLRQARELTDHQGAEPAFLFGLELIICGLEKQLKCESGS

SEQ ID NO: 1211 - protein, 208 aa, Artificial sequence
  rSuR L1-36
MGSRLDKSKVINSALELLNEVGIEGLTTRKLAQKLGVEQPTLYWHVKNKRALLDALAIEMADRHHTHFCPLEGESWQDFLRNAAKSMRCALLSHRDGAKVRLGTAWTEKQYETHENVLAFLCQQGFSLENALYALKAVSGFTLGCVLKDQEMQVAKEERETPTTDSMPPLLRQATELVDHQGAEPAFLFGLELIICGLEKQLKCESGS

SEQ ID NO: 1212 - protein, 208 aa, Artificial sequence
  rSuR L1-39
MGSRLDKSKVINSALELLNEVGIEGLTTRKLAQKLGVEQPTLYWHVKNKRALLDALAIEMMDRHQTHFCPLEGESWQDFLRNTAKSYRCALLSHRDGAKVILGTRWTEKQYETRENVLAFLCQQGFSLENALYAWAAVGPFTLGCVLRDQERQVAKEERETPTTDSMPPLLRQALELMDHQGAEPAFLFGLELIICGLEKQLKCESGS

SEQ ID NO: 1213 - protein, 208 aa, Artificial sequence
  rSuR L1-41
MGSRLDKSKVINSALELLNEVGIEGLTTRKLAQKLGVEQPTLYWHVKNKRALLDALAIEMLDRNQTHFCPLEGESWQDFLRNNAKSWRCALLSHRDGAKVMLGTRNTEKQYETAENGLAFLCQQGFSLENALYACRAVWTFTLGCVLDDQETQVAKEERETPTSDSMPPLLRQAMELKDHQGAEPAFLFGLELIICGLEKQLKCESGS

SEQ ID NO: 1214 - DNA, 627 bp, Artificial sequence
  rSuR L1-18 CDS
atgggatctagattagataaaagtaaagtgattaacagcgcattagagctgcttaatgaggtcggaatcgaaggtttaacaacccgtaaactcgcccagaagctaggtgtagagcagcctacattgtattggcatgtaaaaaataagcgagctctgctcgacgccttagccattgagatgctggataggcacctgactcacttttgccctttagaaggggaaagctggcaagattttttacgtaataacgctaaaagtatgagatgtgctttactaagtcatcgcgatggagcaaaagtatggttaggtacaggctttacagaaaaacagtatgaaactaaggaaaatcggttagcctttttatgccaacaaggtttttcactagagaatgcattatatgcaatccgcgctgtgtcgcgttttactttaggttgcgtattgcaggatcaagagcctcaagtcgctaaagaagaaagggaaacacctactactgatagtatgccgccattattacgacaagctgtggaattatttgatcaccaaggtgcagagccagccttcttattcggccttgaattgatcatatgcggattagaaaaacaacttaaatgtgaaagtgagtcttaa

SEQ ID NO: 1215 - DNA, 627 bp, Artificial sequence
  rSuR L1-21 CDS
atgggatctagattagataaaagtaaagtgattaacagcgcattagagctgcttaatgaggtcggaatcgaaggtttaacaacccgtaaactcgcccagaagctaggtgtagagcagcctacattgtattggcatgtaaaaaataagcgagctctgctcgacgccttagccattgagatgctggataggcacgcgactcacttttgccctttagaaggggaaagctggcaagattttttacgtaataacgctaaaagttttagatgtgctttactaagtcatcgcgatggagcaaaagtatgtttaggtacagcgggtacagaaaaacagtatgaaactctcgaaaattgtttagcctttttatgccaacaaggtttttcactagagaatgcattatatgcaaggagcgctgtggtgtgttttactttaggttgcgtattgtttgatcaagagatgcaagtcgctaaagaagaaagggaaacacctactactgatagtatgccgccattattacgacaagctgcggaattactggatcaccaaggtgcagagccagccttcttattcggccttgaattgatcatatgcggattagaaaaacaacttaaatgtgaaagtgggtcttaa

SEQ ID NO: 1216 - DNA, 627 bp, Artificial sequence
  rSuR L1-25 CDS
atgggatctagattagataaaagtaaagtgattaacagcgcattagagctgcttaatgaggtcggaatcgaaggtttaacaacccgtaaactcgcccagaagctaggtgtagagcagcctacattgtattggcatgtaaaaaataagcgagctctgctcgacgccttagccattgagatgctggataggcacgcgactcacttttgccctttagaaggggaaagctggcaagattttttacgtaatactgctaaaagtatgagatgtgctttactaagtcatcgcgatggagcaaaagtacttttaggtacagcgactacagaaaaacagtatgaaactctcgaaaatttgttagcctttttataccaacaaggtttttcactagagaatgcattatatgcatggcaggctgtgtggcgttttactttaggttgcgtattgattgatcaagagacgcaagtcgctaaagaagaaagggaaacacctactactgatagtatgccgccattattacgacaagctgtggaattaaaggatcaccaaggtgcagagccagccttcttattcggccttgaattgatcatatgcggattagaaaaacaacttaaatgtgaaactgggtcttaa

SEQ ID NO: 1217 - DNA, 627 bp, Artificial sequence
  rSuR L1-33 CDS
atgggatctagattagataaaagtaaagtgattaacagcgcattagagctgcttaatgaggtcggaatcgaaggtttaacaacccgtaaactcgcccagaagctaggtgtagagcagcctacattgtattggcatgtaaaaaataagcgagctctgctcgacgccttagccattgagatgctggataggcacgcgactcacttttgccctttagaaggggaaagctggcaagattttttacgtaataacgctaaaagtatgagatgtgctttactaagtcatcgcgatggagcaaaagtacagttaggtacagcggcgacagaaaaacagtatgaaactctggaaaataagttagcctttttatgccaacaaggtttttcactagagaatgcattatatgcacacagcgctgtgactcagtttactttaggttgcgtattgcgggatcaagagggtcaagtcgctaaagaagaaagggaaacacctactactgatagtatgccgccattattacgacaagctcgggaattacgtgatcaccaaggtgcagagccagccttcttattcggccttgaattgatcatatgcggattagaaaaacaacttaaatgtgaaagtgggtcttaa

SEQ ID NO: 1218 - DNA, 627 bp, Artificial sequence
  rSuR L1-34 CDS
atgggatctagattagataaaagtaaagtgattaacagcgcattagagctgcttaatgaggtcggaatcgaaggtttaacaacccgtaaactcgcccagaagctaggtgtagagcagcctacattgtattggcatgtaaaaaataagcgagctctgctcgacgccttagccattgagatggcggataggcacaatactcacttttgccctttagaaggggaaagctggcaagattttttacgtaatgctgctagaagtatgagatgtgctttactaagtcatcgcgatggagccaaagtatatttaggtacagcgaggacagaaaaacagtatgaaactaccgaaaatgttttagcctttttatgccaacaaggtttttcactagagaatgcattatatgcagtgcgcgctgtgcctcgttttactttaggttgcgtattgttggatcaagagaggcaagtcgctaaagaagaaagggaaacacctactactgatagtatgccgccattattacgacaagctagggaattaacggatcaccaaggtgcagagccagccttcttattcggccttgaattgatcatatgcggattagaaaaacaacttaaatgtgaaagtgggtcttaa

SEQ ID NO: 1219 - DNA, 627 bp, Artificial sequence
  rSuR L1-36 CDS
atgggatctagattagataaaagtaaagtgattaacagcgcattagagctgcttaatgaggtcggaatcgaaggtttaacaacccgtaaactcgcccagaagctaggtgtagagcagcctacattgtattggcatgtaaaaaataagcgagctctgctcgacgccttagccattgagatggcggataggcaccatactcacttttgccctttagaaggggaaagctggcaagattttttacgtaatgctgctaaaagtatgagatgtgctttactaagtcatcgcgatggagcaaaagtacgtttaggtacagcgtggacagaaaaacagtatgaaactcacgaaaatgtgttagcctttttatgccaacaaggtttttcactagagaatgcattatatgcactgaaggctgtgtcagggtttactttaggttgcgtattgaaggatcaagagatgcaagtcgctaaagaagaaagggaaacacctactactgatagtatgccgccattattacgacaagctactgaattagttgatcaccaaggtgcagagccagccttcttattcggccttgaattgatcatatgcggattagaaaaacaacttaaatgtgaaagtgggtcttaa

SEQ ID NO: 1220 - DNA, 627 bp, Artificial sequence
  rSuR L1-39 CDS
atgggatctagattagataaaagtaaagtgattaacagcgcattagagctgcttaatgaggtcggaatcgaaggtttaacaacccgtaaactcgcccagaagctaggtgtagagcagcctacattgtattggcatgtaaaaaataagcgagctctgctcgacgccttagccattgagatgatggataggcaccagactcacttttgccctttagaaggggaaagctggcaagattttttacgtaatactgctaaaagttatagatgtgctttactaagtcatcgcgatggagcaaaagtaattttaggtacacgctggacagaaaaacagtatgaaactcgcgaaaatgttttagcctttttatgccaacaaggtttttcactagagaatgcattatatgcatgggccgctgtgggtccgtttactttaggttgcgtattgcgtgatcaagagcggcaagtcgctaaagaagaaagggaaacacctactactgatagtatgccgccattattacgacaagctttggaattaatggatcaccaaggtgcagagccagccttcttattcggccttgaattgatcatatgcggattagaaaaacaacttaaatgtgaaagtgggtcttaa

SEQ ID NO: 1221 - DNA, 627 bp, Artificial sequence
  rSuR L1-41 CDS
atgggatctagattagataaaagtaaagtgattaacagcgcattagagctgcttaatgaggtcggaatcgaaggtttaacaacccgtaaactcgcccagaagctaggtgtagagcagcctacattgtattggcatgtaaaaaataagcgagctctgctcgacgccttagccattgagatgctggataggaaccagactcacttttgccctttagaaggggaaagctggcaagattttttacgtaataacgctaaaagttggagatgtgctttactaagtcatcgcgatggagcaaaagtaatgttaggtacacgcaatacagaaaaacagtatgaaactgccgaaaatgggttagcctttttatgccaacaaggtttttcactagagaatgcattatatgcatgccgcgctgtgtggacgtttactttaggttgcgtattggatgatcaagagacgcaagtcgctaaagaagaaagggaaacacctactagtgatagtatgccgccattattacgacaagctatggaattaaaggatcaccaaggtgcagagccagccttcttattcggccttgaattgatcatatgcggattagaaaaacaacttaaatgtgaaagtgggtcttaa

SEQ ID NO: 1222 - DNA, 8131 bp, Artificial sequence
  PHP37586A
cgcgccggtacccgggtaccgagctcactagacgcggtgaaattacctaattaacaccggtgtttatcaaacaagtttgtacaaaaaagcaggctccggccagaatggcccggaccgggttaccgaattctagaaatccgtcaacatggtggagcacgacactctcgtctactccaagaatatcaaagatacagtctcagaagaccaaagggctattgagacttttcaacaaagggtaatatcgggaaacctcctcggattccattgcccagctatctgtcacttcatcaaaaggacagtagaaaaggaaggtggcacctacaaatgccatcattgcgataaaggaaaggctatcgttcaagatgcctctgccgacagtggtcccaaagatggacccccacccacgaggagcatcgtggaaaaagaagacgttccaaccacgtcttcaaagcaagtggattgatgtgatatctccactgacgtaagggatgacgcacaatcccactagactctatcagtgatagagtgtatataagactctatcagtgatagagtgaactctatcagtgatagagttgtacttatttttacaacaattaccaacaacaacaaacaacaaacaacattacaattactatttacaattacagtcgacccgggatccatggcctcctccgaggacgtcatcaaggagttcatgcgcttcaaggtgcgcatggagggctccgtgaacggccacgagttcgagatcgagggcgagggcgagggccgcccctacgagggcacccagaccgccaagctgaaggtgaccaagggcggccccctgcccttcgcctgggacatcctgtccccccagttccagtacggctccaaggtgtacgtgaagcaccccgccgacatccccgactacaagaagctgtccttccccgagggcttcaagtgggagcgcgtgatgaacttcgaggacggcggcgtggtgaccgtgacccaggactcctccctgcaggacggctccttcatctacaaggtgaagttcatcggcgtgaacttcccctccgacggccccgtaatgcagaagaagactatgggctgggaggcctccaccgagcgcctgtacccccgcgacggcgtgctgaagggcgagatccacaaggccctgaagctgaaggacggcggccactacctggtggagttcaagtccatctacatggccaagaagcccgtgcagctgcccggctactactacgtggactccaagctggacatcacctcccacaacgaggactacaccatcgtggagcagtacgagcgcgccgagggccgccaccacctgttcctgtagcggccccgctgaaatcaccagtctctctctacaaatctatctctctctataataatgtgtgagtagttcccagataagggaattagggttcttatagggtttcgctcatgtgttgagcatataagaaacccttagtatgtatttgtatttgtaaaatacttctatcaataaaatttctaattcctaaaaccaaaatccagtggcgagctcgagggtttacttattttgtgggtatctatacttttattagatttttaatcaggctcctgatttctttttatttcgattgaattcctgaacttgtattattcagtagatcgaataaattataaaaagataaaatcataaaataatattttatcctatcaatcatattaaagcaatgaatatgtaaaattaatcttatctttattttaaaaaatcatataggtttagtatttttttaaaaataaagataggattagttttactattcactgcttattacttttaaaaaaatcataaaggtttagtatttttttaaaataaatataggaatagttttactattcactgctttaatagaaaaatagtttaaaatttaagatagttttaatcccagcatttgccacgtttgaacgtgagccgaaacgatgtcgttacattatcttaacctagctgaaacgatgtcgtcataatatcgccaaatgccaactggactacgtcgaacccacaaatcccacaaagcgcgtgaaatcaaatcgctcaaaccacaaaaaagaacaacgcgtttgttacacgctcaatcccacgcgagtagagcacagtaaccttcaaataagcgaatggggcataatcagaaatccgaaataaacctaggggcattatcggaaatgaaaagtagctcactcaatataaaaatctaggaaccctagttttcgttatcactctgtgctccctcgctctatttctcagtctctgtgtttgcggctgaggattccgaacgagtgaccttcttcgtttctcgcaaaggtaacagcctctgctcttgtctcttcgattcgatctatgcctgtctcttatttacgatgatgtttcttcggttatgtttttttatttatgctttatgctgttgatgttcggttgtttgtttcgctttgtttttgtggttcagttttttaggattcttttggtttttgaatcgattaatcggaagagattttcgagttatttggtgtgttggaggtgaatcttttttttgaggtcatagatctgttgtatttgtgttataaacatgcgactttgtatgattttttacgaggttatgatgttctggttgttttattatgaatctgttgagacagaaccatgatttttgttgatgttcgtttacactattaaaggtttgttttaacaggattaaaagttttttaagcatgttgaaggagtcttgtagatatgtaaccgtcgatagtttttttgtgggtttgttcacatgttatcaagcttaatcttttactatgtatgcgaccatatctggatccagcaaaggcgattttttaattccttgtgaaacttttgtaatatgaagttgaaattttgttattggtaaactataaatgtgtgaagttggagtatacctttaccttcttatttggctttgtgatagtttaatttatatgtattttgagttctgacttgtatttctttgaattgattctagtttaagtaatccatggccagactcgacaagagcaaggtgatcaacagcgcactggagctgctgaacgaggtcggaatcgaaggcctcacaacccgtaagctcgcccagaagctcggggttgagcagcctacattgtactggcacgtcaagaacaagcgagctctgctagacgctatggccattgagatgctcgataggcacgctacccacgtgtgccctttggaaggggaaagctggcaagacttcttgaggaacaacgctaagatcatgagatgtgctttgctcagtcaccgtgatggagccaaggtctgtctaggtacgggcttcacggagcaacagtatgaaactgctgagaacagccttgccttcctgtgccaacaaggtttctcccttgagcatgccctctacgcaatgcaagctgctgggatcttcactctgggttgcgtcttgctggatcaagagctgcaagtcgctaaggaggagagggaaacacctactactgatagtatgccgccactggttcgacaagctctggaactcaacgatcaccaaggtgcagagccagccttcctgttcggccttgaactgatcatatgcggattggagaagcagctgaagtgtgaaagtgggtcttaatgatagctgcaggcatgccgctgaaatcaccagtctctctctacaaatctatctctctctataataatgtgtgagtagttcccagataagggaattagggttcttatagggtttcgctcatgtgttgagcatataagaaacccttagtatgtatttgtatttgtaaaatacttctatcaataaaatttctaattcctaaaaccaaaatccagtggcgagctcgagcccgggcacccagctttcttgtacaaagtggttcgataaacactagtaacggccgccagtgtgctggaattcgcccttcccaagctttgctctagatcaaactcacatccaaacataacatggatatcttccttaccaatcatactaattattttgggttaaatattaatcattatttttaagatattaattaagaaattaaaagattttttaaaaaaatgtataaaattatattattcatgatttttcatacatttgattttgataataaatatattttttttaatttcttaaaaaatgttgcaagacacttattagacatagtcttgttctgtttacaaaagcattcatcatttaatacattaaaaaatatttaatactaacagtagaatcttcttgtgagtggtgtgggagtaggcaacctggcattgaaacgagagaaagagagtcagaaccagaagacaaataaaaagtatgcaacaaacaaatcaaaatcaaagggcaaaggctggggttggctcaattggttgctacattcaattttcaactcagtcaacggttgagattcactctgacttccccaatctaagccgcggatgcaaacggttgaatctaacccacaatccaatctcgttacttaggggcttttccgtcattaactcacccctgccacccggtttccctataaattggaactcaatgctcccctctaaactcgtatcgcttcagagttgagaccaagacacactcgttcatatatctctctgctcttctcttctcttctacctctcaaggtacttttcttctccctctaccaaatcctagattccgtggttcaatttcggatcttgcacttctggtttgctttgccttgctttttcctcaactgggtccatctaggatccatgtgaaactctactctttctttaatatctgcggaatacgcgtttgactttcagatctagtcgaaatcatttcataattgcctttctttcttttagcttatgagaaataaaatcactttttttttatttcaaaataaaccttgggccttgtgctgactgagatggggtttggtgattacagaattttagcgaattttgtaattgtacttgtttgtctgtagttttgttttgttttcttgtttctcatacattccttaggcttcaattttattcgagtataggtcacaataggaattcaaactttgagcaggggaattaatcccttccttcaaatccagtttgtttgtatatatgtttaaaaaatgaaacttttgctttaaattctattataactttttttatggctgaaatttttgcatgtgtctttgctctctgttgtaaatttactgtttaggtactaactctaggcttgttgtgcagtttttgaagtataacaacagaagttcctattccgaagttcctattctctagaaagtataggaacttccaccacacaacacaatggcggccaccgcttccagaaccacccgattctcttcttcctcttcacaccccaccttccccaaacgcattactagatccaccctccctctctctcatcaaaccctcaccaaacccaaccacgctctcaaaatcaaatgttccatctccaaaccccccacggcggcgcccttcaccaaggaagcgccgaccacggagcccttcgtgtcacggttcgcctccggcgaacctcgcaagggcgcggacatccttgtggaggcgctggagaggcagggcgtgacgacggtgttcgcgtaccccggcggtgcgtcgatggagatccaccaggcgctcacgcgctccgccgccatccgcaacgtgctcccgcgccacgagcagggcggcgtcttcgccgccgaaggctacgcgcgttcctccggcctccccggcgtctgcattgccacctccggccccggcgccaccaacctcgtgagcggcctcgccgacgctttaatggacagcgtcccagtcgtcgccatcaccggccaggtcgcccgccggatgatcggcaccgacgccttccaagaaaccccgatcgtggaggtgagcagatccatcacgaagcacaactacctcatcctcgacgtcgacgacatcccccgcgtcgtcgccgaggctttcttcgtcgccacctccggccgccccggtccggtcctcatcgacattcccaaagacgttcagcagcaactcgccgtgcctaattgggacgagcccgttaacctccccggttacctcgccaggctgcccaggccccccgccgaggcccaattggaacacattgtcagactcatcatggaggcccaaaagcccgttctctacgtcggcggtggcagtttgaattccagtgctgaattgaggcgctttgttgaactcactggtattcccgttgctagcactttaatgggtcttggaacttttcctattggtgatgaatattcccttcagatgctgggtatgcatggtactgtttatgctaactatgctgttgacaatagtgatttgttgcttgcctttggggtaaggtttgatgaccgtgttactgggaagcttgaggcttttgctagtagggctaagattgttcacattgatattgattctgccgagattgggaagaacaagcaggcgcacgtgtcggtttgcgcggatttgaagttggccttgaagggaattaatatgattttggaggagaaaggagtggagggtaagtttgatcttggaggttggagagaagagattaatgtgcagaaacacaagtttccattgggttacaagacattccaggacgcgatttctccgcagcatgctatcgaggttcttgatgagttgactaatggagatgctattgttagtactggggttgggcagcatcaaatgtgggctgcgcagttttacaagtacaagagaccgaggcagtggttgacctcagggggtcttggagccatgggttttggattgcctgcggctattggtgctgctgttgctaaccctggggctgttgtggttgacattgatggggatggtagtttcatcatgaatgttcaggagttggccactataagagtggagaatctcccagttaagatattgttgttgaacaatcagcatttgggtatggtggttcagttggaggataggttctacaagtccaatagagctcacacctatcttggagatccgtctagcgagagcgagatattcccaaacatgctcaagtttgctgatgcttgtgggataccggcagcgcgagtgacgaagaaggaagagcttagagcggcaattcagagaatgttggacacccctggcccctaccttcttgatgtcattgtgccccatcaggagcatgtgttgccgatgattcccagtaatggatccttcaaggatgtgataactgagggtgatggtagaacgaggtactgattgcctagaccaaatgttccttgatgcttgttttgtacaatatatataagataatgctgtcctagttgcaggatttggcctgtggtgagcatcatagtctgtagtagttttggtagcaagacattttattttccttttatttaacttactacatgcagtagcatctatctatctctgtagtctgatatctcctgttgtctgtattgtgccgttggattttttgctgtagtgagactgaaaatgatgtgctagtaataatatttctgttagaaatctaagtagagaatctgttgaagaagtcaaaagctaatggaatcaggttacatattcaatgtttttctttttttagcggttggtagacgtgtagattcaacttctcttggagctcacctaggcaatcagtaaaatgcatattccttttttaacttgccatttatttacttttagtggaaattgtgaccaatttgttcatgtagaacggatttggaccattgcgtccacaaaacgtctcttttgctcgatcttcacaaagcgataccgaaatccagagatagttttcaaaagtcagaaatggcaaagttataaatagtaaaacagaatagatgctgtaatcgacttcaataacaagtggcatcacgtttctagttctagacccatcagctgggccggcccagctgatgatcccggtgaagttcctattccgaagttcctattctccagaaagtataggaacttcactagagcttgcggccgcgcatgctgacttaatcagctaacgccactcgagggggggcccggtaccgg

SEQ ID NO: 1223 - DNA, 8131 bp, Artificial sequence
  PHP37587A
cgcgccggtacccgggtaccgagctcactagacgcggtgaaattacctaattaacaccggtgtttatcaaacaagtttgtacaaaaaagcaggctccggccagaatggcccggaccgggttaccgaattctagaaatccgtcaacatggtggagcacgacactctcgtctactccaagaatatcaaagatacagtctcagaagaccaaagggctattgagacttttcaacaaagggtaatatcgggaaacctcctcggattccattgcccagctatctgtcacttcatcaaaaggacagtagaaaaggaaggtggcacctacaaatgccatcattgcgataaaggaaaggctatcgttcaagatgcctctgccgacagtggtcccaaagatggacccccacccacgaggagcatcgtggaaaaagaagacgttccaaccacgtcttcaaagcaagtggattgatgtgatatctccactgacgtaagggatgacgcacaatcccactagactctatcagtgatagagtgtatataagactctatcagtgatagagtgaactctatcagtgatagagttgtacttatttttacaacaattaccaacaacaacaaacaacaaacaacattacaattactatttacaattacagtcgacccgggatccatggcctcctccgaggacgtcatcaaggagttcatgcgcttcaaggtgcgcatggagggctccgtgaacggccacgagttcgagatcgagggcgagggcgagggccgcccctacgagggcacccagaccgccaagctgaaggtgaccaagggcggccccctgcccttcgcctgggacatcctgtccccccagttccagtacggctccaaggtgtacgtgaagcaccccgccgacatccccgactacaagaagctgtccttccccgagggcttcaagtgggagcgcgtgatgaacttcgaggacggcggcgtggtgaccgtgacccaggactcctccctgcaggacggctccttcatctacaaggtgaagttcatcggcgtgaacttcccctccgacggccccgtaatgcagaagaagactatgggctgggaggcctccaccgagcgcctgtacccccgcgacggcgtgctgaagggcgagatccacaaggccctgaagctgaaggacggcggccactacctggtggagttcaagtccatctacatggccaagaagcccgtgcagctgcccggctactactacgtggactccaagctggacatcacctcccacaacgaggactacaccatcgtggagcagtacgagcgcgccgagggccgccaccacctgttcctgtagcggccccgctgaaatcaccagtctctctctacaaatctatctctctctataataatgtgtgagtagttcccagataagggaattagggttcttatagggtttcgctcatgtgttgagcatataagaaacccttagtatgtatttgtatttgtaaaatacttctatcaataaaatttctaattcctaaaaccaaaatccagtggcgagctcgagggtttacttattttgtgggtatctatacttttattagatttttaatcaggctcctgatttctttttatttcgattgaattcctgaacttgtattattcagtagatcgaataaattataaaaagataaaatcataaaataatattttatcctatcaatcatattaaagcaatgaatatgtaaaattaatcttatctttattttaaaaaatcatataggtttagtatttttttaaaaataaagataggattagttttactattcactgcttattacttttaaaaaaatcataaaggtttagtatttttttaaaataaatataggaatagttttactattcactgctttaatagaaaaatagtttaaaatttaagatagttttaatcccagcatttgccacgtttgaacgtgagccgaaacgatgtcgttacattatcttaacctagctgaaacgatgtcgtcataatatcgccaaatgccaactggactacgtcgaacccacaaatcccacaaagcgcgtgaaatcaaatcgctcaaaccacaaaaaagaacaacgcgtttgttacacgctcaatcccacgcgagtagagcacagtaaccttcaaataagcgaatggggcataatcagaaatccgaaataaacctaggggcattatcggaaatgaaaagtagctcactcaatataaaaatctaggaaccctagttttcgttatcactctgtgctccctcgctctatttctcagtctctgtgtttgcggctgaggattccgaacgagtgaccttcttcgtttctcgcaaaggtaacagcctctgctcttgtctcttcgattcgatctatgcctgtctcttatttacgatgatgtttcttcggttatgtttttttatttatgctttatgctgttgatgttcggttgtttgtttcgctttgtttttgtggttcagttttttaggattcttttggtttttgaatcgattaatcggaagagattttcgagttatttggtgtgttggaggtgaatcttttttttgaggtcatagatctgttgtatttgtgttataaacatgcgactttgtatgattttttacgaggttatgatgttctggttgttttattatgaatctgttgagacagaaccatgatttttgttgatgttcgtttacactattaaaggtttgttttaacaggattaaaagttttttaagcatgttgaaggagtcttgtagatatgtaaccgtcgatagtttttttgtgggtttgttcacatgttatcaagcttaatcttttactatgtatgcgaccatatctggatccagcaaaggcgattttttaattccttgtgaaacttttgtaatatgaagttgaaattttgttattggtaaactataaatgtgtgaagttggagtatacctttaccttcttatttggctttgtgatagtttaatttatatgtattttgagttctgacttgtatttctttgaattgattctagtttaagtaatccatggccagactcgacaagagcaaggtgatcaacagcgcactggagctgctgaacgaggtcggaatcgaaggcctcacaacccgtaagctcgcccagaagctcggggttgagcagcctacattgtactggcacgtcaagaacaagcgagctctgctagacgctatggccattgagatgctcgataggcacgctacccactactgccctttggaaggggaaagctggcaagacttcttgaggaacaacgctaagtccatgagatgtgctttgctcagtcaccgtgatggagccaaggtctgtctaggtacgggcttcacggagcaacagtatgaaactgctgagaacagccttgccttcctgtgccaacaaggtttctcccttgagaacgccctctacgcaatgcaagctgttgggatctacactctgggttgcgtcttgctggatcaagagctgcaagtcgctaaggaggagagggaaacacctactactgatagtatgccgccactggttcgacaagctctggaactcaaggatcaccaaggtgcagagccagccttcctgttcggccttgaactgatcatatgcggattggagaagcagctgaagtgtgaaagtgggtcttaatgatagctgcaggcatgccgctgaaatcaccagtctctctctacaaatctatctctctctataataatgtgtgagtagttcccagataagggaattagggttcttatagggtttcgctcatgtgttgagcatataagaaacccttagtatgtatttgtatttgtaaaatacttctatcaataaaatttctaattcctaaaaccaaaatccagtggcgagctcgagcccgggcacccagctttcttgtacaaagtggttcgataaacactagtaacggccgccagtgtgctggaattcgcccttcccaagctttgctctagatcaaactcacatccaaacataacatggatatcttccttaccaatcatactaattattttgggttaaatattaatcattatttttaagatattaattaagaaattaaaagattttttaaaaaaatgtataaaattatattattcatgatttttcatacatttgattttgataataaatatattttttttaatttcttaaaaaatgttgcaagacacttattagacatagtcttgttctgtttacaaaagcattcatcatttaatacattaaaaaatatttaatactaacagtagaatcttcttgtgagtggtgtgggagtaggcaacctggcattgaaacgagagaaagagagtcagaaccagaagacaaataaaaagtatgcaacaaacaaatcaaaatcaaagggcaaaggctggggttggctcaattggttgctacattcaattttcaactcagtcaacggttgagattcactctgacttccccaatctaagccgcggatgcaaacggttgaatctaacccacaatccaatctcgttacttaggggcttttccgtcattaactcacccctgccacccggtttccctataaattggaactcaatgctcccctctaaactcgtatcgcttcagagttgagaccaagacacactcgttcatatatctctctgctcttctcttctcttctacctctcaaggtacttttcttctccctctaccaaatcctagattccgtggttcaatttcggatcttgcacttctggtttgctttgccttgctttttcctcaactgggtccatctaggatccatgtgaaactctactctttctttaatatctgcggaatacgcgtttgactttcagatctagtcgaaatcatttcataattgcctttctttcttttagcttatgagaaataaaatcactttttttttatttcaaaataaaccttgggccttgtgctgactgagatggggtttggtgattacagaattttagcgaattttgtaattgtacttgtttgtctgtagttttgttttgttttcttgtttctcatacattccttaggcttcaattttattcgagtataggtcacaataggaattcaaactttgagcaggggaattaatcccttccttcaaatccagtttgtttgtatatatgtttaaaaaatgaaacttttgctttaaattctattataactttttttatggctgaaatttttgcatgtgtctttgctctctgttgtaaatttactgtttaggtactaactctaggcttgttgtgcagtttttgaagtataacaacagaagttcctattccgaagttcctattctctagaaagtataggaacttccaccacacaacacaatggcggccaccgcttccagaaccacccgattctcttcttcctcttcacaccccaccttccccaaacgcattactagatccaccctccctctctctcatcaaaccctcaccaaacccaaccacgctctcaaaatcaaatgttccatctccaaaccccccacggcggcgcccttcaccaaggaagcgccgaccacggagcccttcgtgtcacggttcgcctccggcgaacctcgcaagggcgcggacatccttgtggaggcgctggagaggcagggcgtgacgacggtgttcgcgtaccccggcggtgcgtcgatggagatccaccaggcgctcacgcgctccgccgccatccgcaacgtgctcccgcgccacgagcagggcggcgtcttcgccgccgaaggctacgcgcgttcctccggcctccccggcgtctgcattgccacctccggccccggcgccaccaacctcgtgagcggcctcgccgacgctttaatggacagcgtcccagtcgtcgccatcaccggccaggtcgcccgccggatgatcggcaccgacgccttccaagaaaccccgatcgtggaggtgagcagatccatcacgaagcacaactacctcatcctcgacgtcgacgacatcccccgcgtcgtcgccgaggctttcttcgtcgccacctccggccgccccggtccggtcctcatcgacattcccaaagacgttcagcagcaactcgccgtgcctaattgggacgagcccgttaacctccccggttacctcgccaggctgcccaggccccccgccgaggcccaattggaacacattgtcagactcatcatggaggcccaaaagcccgttctctacgtcggcggtggcagtttgaattccagtgctgaattgaggcgctttgttgaactcactggtattcccgttgctagcactttaatgggtcttggaacttttcctattggtgatgaatattcccttcagatgctgggtatgcatggtactgtttatgctaactatgctgttgacaatagtgatttgttgcttgcctttggggtaaggtttgatgaccgtgttactgggaagcttgaggcttttgctagtagggctaagattgttcacattgatattgattctgccgagattgggaagaacaagcaggcgcacgtgtcggtttgcgcggatttgaagttggccttgaagggaattaatatgattttggaggagaaaggagtggagggtaagtttgatcttggaggttggagagaagagattaatgtgcagaaacacaagtttccattgggttacaagacattccaggacgcgatttctccgcagcatgctatcgaggttcttgatgagttgactaatggagatgctattgttagtactggggttgggcagcatcaaatgtgggctgcgcagttttacaagtacaagagaccgaggcagtggttgacctcagggggtcttggagccatgggttttggattgcctgcggctattggtgctgctgttgctaaccctggggctgttgtggttgacattgatggggatggtagtttcatcatgaatgttcaggagttggccactataagagtggagaatctcccagttaagatattgttgttgaacaatcagcatttgggtatggtggttcagttggaggataggttctacaagtccaatagagctcacacctatcttggagatccgtctagcgagagcgagatattcccaaacatgctcaagtttgctgatgcttgtgggataccggcagcgcgagtgacgaagaaggaagagcttagagcggcaattcagagaatgttggacacccctggcccctaccttcttgatgtcattgtgccccatcaggagcatgtgttgccgatgattcccagtaatggatccttcaaggatgtgataactgagggtgatggtagaacgaggtactgattgcctagaccaaatgttccttgatgcttgttttgtacaatatatataagataatgctgtcctagttgcaggatttggcctgtggtgagcatcatagtctgtagtagttttggtagcaagacattttattttccttttatttaacttactacatgcagtagcatctatctatctctgtagtctgatatctcctgttgtctgtattgtgccgttggattttttgctgtagtgagactgaaaatgatgtgctagtaataatatttctgttagaaatctaagtagagaatctgttgaagaagtcaaaagctaatggaatcaggttacatattcaatgtttttctttttttagcggttggtagacgtgtagattcaacttctcttggagctcacctaggcaatcagtaaaatgcatattccttttttaacttgccatttatttacttttagtggaaattgtgaccaatttgttcatgtagaacggatttggaccattgcgtccacaaaacgtctcttttgctcgatcttcacaaagcgataccgaaatccagagatagttttcaaaagtcagaaatggcaaagttataaatagtaaaacagaatagatgctgtaatcgacttcaataacaagtggcatcacgtttctagttctagacccatcagctgggccggcccagctgatgatcccggtgaagttcctattccgaagttcctattctccagaaagtataggaacttcactagagcttgcggccgcgcatgctgacttaatcagctaacgccactcgagggggggcccggtaccgg

SEQ ID NO: 1224 - DNA, 8131 bp, Artificial sequence
  PHP37588A
cgcgccggtacccgggtaccgagctcactagacgcggtgaaattacctaattaacaccggtgtttatcaaacaagtttgtacaaaaaagcaggctccggccagaatggcccggaccgggttaccgaattctagaaatccgtcaacatggtggagcacgacactctcgtctactccaagaatatcaaagatacagtctcagaagaccaaagggctattgagacttttcaacaaagggtaatatcgggaaacctcctcggattccattgcccagctatctgtcacttcatcaaaaggacagtagaaaaggaaggtggcacctacaaatgccatcattgcgataaaggaaaggctatcgttcaagatgcctctgccgacagtggtcccaaagatggacccccacccacgaggagcatcgtggaaaaagaagacgttccaaccacgtcttcaaagcaagtggattgatgtgatatctccactgacgtaagggatgacgcacaatcccactagactctatcagtgatagagtgtatataagactctatcagtgatagagtgaactctatcagtgatagagttgtacttatttttacaacaattaccaacaacaacaaacaacaaacaacattacaattactatttacaattacagtcgacccgggatccatggcctcctccgaggacgtcatcaaggagttcatgcgcttcaaggtgcgcatggagggctccgtgaacggccacgagttcgagatcgagggcgagggcgagggccgcccctacgagggcacccagaccgccaagctgaaggtgaccaagggcggccccctgcccttcgcctgggacatcctgtccccccagttccagtacggctccaaggtgtacgtgaagcaccccgccgacatccccgactacaagaagctgtccttccccgagggcttcaagtgggagcgcgtgatgaacttcgaggacggcggcgtggtgaccgtgacccaggactcctccctgcaggacggctccttcatctacaaggtgaagttcatcggcgtgaacttcccctccgacggccccgtaatgcagaagaagactatgggctgggaggcctccaccgagcgcctgtacccccgcgacggcgtgctgaagggcgagatccacaaggccctgaagctgaaggacggcggccactacctggtggagttcaagtccatctacatggccaagaagcccgtgcagctgcccggctactactacgtggactccaagctggacatcacctcccacaacgaggactacaccatcgtggagcagtacgagcgcgccgagggccgccaccacctgttcctgtagcggccccgctgaaatcaccagtctctctctacaaatctatctctctctataataatgtgtgagtagttcccagataagggaattagggttcttatagggtttcgctcatgtgttgagcatataagaaacccttagtatgtatttgtatttgtaaaatacttctatcaataaaatttctaattcctaaaaccaaaatccagtggcgagctcgagggtttacttattttgtgggtatctatacttttattagatttttaatcaggctcctgatttctttttatttcgattgaattcctgaacttgtattattcagtagatcgaataaattataaaaagataaaatcataaaataatattttatcctatcaatcatattaaagcaatgaatatgtaaaattaatcttatctttattttaaaaaatcatataggtttagtatttttttaaaaataaagataggattagttttactattcactgcttattacttttaaaaaaatcataaaggtttagtatttttttaaaataaatataggaatagttttactattcactgctttaatagaaaaatagtttaaaatttaagatagttttaatcccagcatttgccacgtttgaacgtgagccgaaacgatgtcgttacattatcttaacctagctgaaacgatgtcgtcataatatcgccaaatgccaactggactacgtcgaacccacaaatcccacaaagcgcgtgaaatcaaatcgctcaaaccacaaaaaagaacaacgcgtttgttacacgctcaatcccacgcgagtagagcacagtaaccttcaaataagcgaatggggcataatcagaaatccgaaataaacctaggggcattatcggaaatgaaaagtagctcactcaatataaaaatctaggaaccctagttttcgttatcactctgtgctccctcgctctatttctcagtctctgtgtttgcggctgaggattccgaacgagtgaccttcttcgtttctcgcaaaggtaacagcctctgctcttgtctcttcgattcgatctatgcctgtctcttatttacgatgatgtttcttcggttatgtttttttatttatgctttatgctgttgatgttcggttgtttgtttcgctttgtttttgtggttcagttttttaggattcttttggtttttgaatcgattaatcggaagagattttcgagttatttggtgtgttggaggtgaatcttttttttgaggtcatagatctgttgtatttgtgttataaacatgcgactttgtatgattttttacgaggttatgatgttctggttgttttattatgaatctgttgagacagaaccatgatttttgttgatgttcgtttacactattaaaggtttgttttaacaggattaaaagttttttaagcatgttgaaggagtcttgtagatatgtaaccgtcgatagtttttttgtgggtttgttcacatgttatcaagcttaatcttttactatgtatgcgaccatatctggatccagcaaaggcgattttttaattccttgtgaaacttttgtaatatgaagttgaaattttgttattggtaaactataaatgtgtgaagttggagtatacctttaccttcttatttggctttgtgatagtttaatttatatgtattttgagttctgacttgtatttctttgaattgattctagtttaagtaatccatggccagactcgacaagagcaaggtgatcaacagcgcactggagctgctgaacgaggtcggaatcgaaggcctcacaacccgtaagctcgcccagaagctcggggttgagcagcctacattgtactggcacgtcaagaacaagcgagctctgctagacgctatggccattgagatgctcgataggcacgctacccactactgccctttggaaggggaaagctggcaagacttcttgaggaacaacgctaagtccatgagatgtgctttgctcagtcaccgtgatggagccaaggtctgtctaggtacgggcttcacggagcaacagtatgaaactgctgagaacagcatggccttcctgtgccaacaaggtttctcccttgagaacgccctctacgcaatgcaagctgttgggatctacactctgggttgcgtcttgctggatcaagagctgcaagtcgctaaggaggagagggaaacacctactactgatagtatgccgccactggttcgacaagctctggaactcaaggatcaccaaggtgcagagccagccttcctgttcggccttgaactgatcatatgcggattggagaagcagctgaagtgtgaaagtgggtcttaatgatagctgcaggcatgccgctgaaatcaccagtctctctctacaaatctatctctctctataataatgtgtgagtagttcccagataagggaattagggttcttatagggtttcgctcatgtgttgagcatataagaaacccttagtatgtatttgtatttgtaaaatacttctatcaataaaatttctaattcctaaaaccaaaatccagtggcgagctcgagcccgggcacccagctttcttgtacaaagtggttcgataaacactagtaacggccgccagtgtgctggaattcgcccttcccaagctttgctctagatcaaactcacatccaaacataacatggatatcttccttaccaatcatactaattattttgggttaaatattaatcattatttttaagatattaattaagaaattaaaagattttttaaaaaaatgtataaaattatattattcatgatttttcatacatttgattttgataataaatatattttttttaatttcttaaaaaatgttgcaagacacttattagacatagtcttgttctgtttacaaaagcattcatcatttaatacattaaaaaatatttaatactaacagtagaatcttcttgtgagtggtgtgggagtaggcaacctggcattgaaacgagagaaagagagtcagaaccagaagacaaataaaaagtatgcaacaaacaaatcaaaatcaaagggcaaaggctggggttggctcaattggttgctacattcaattttcaactcagtcaacggttgagattcactctgacttccccaatctaagccgcggatgcaaacggttgaatctaacccacaatccaatctcgttacttaggggcttttccgtcattaactcacccctgccacccggtttccctataaattggaactcaatgctcccctctaaactcgtatcgcttcagagttgagaccaagacacactcgttcatatatctctctgctcttctcttctcttctacctctcaaggtacttttcttctccctctaccaaatcctagattccgtggttcaatttcggatcttgcacttctggtttgctttgccttgctttttcctcaactgggtccatctaggatccatgtgaaactctactctttctttaatatctgcggaatacgcgtttgactttcagatctagtcgaaatcatttcataattgcctttctttcttttagcttatgagaaataaaatcactttttttttatttcaaaataaaccttgggccttgtgctgactgagatggggtttggtgattacagaattttagcgaattttgtaattgtacttgtttgtctgtagttttgttttgttttcttgtttctcatacattccttaggcttcaattttattcgagtataggtcacaataggaattcaaactttgagcaggggaattaatcccttccttcaaatccagtttgtttgtatatatgtttaaaaaatgaaacttttgctttaaattctattataactttttttatggctgaaatttttgcatgtgtctttgctctctgttgtaaatttactgtttaggtactaactctaggcttgttgtgcagtttttgaagtataacaacagaagttcctattccgaagttcctattctctagaaagtataggaacttccaccacacaacacaatggcggccaccgcttccagaaccacccgattctcttcttcctcttcacaccccaccttccccaaacgcattactagatccaccctccctctctctcatcaaaccctcaccaaacccaaccacgctctcaaaatcaaatgttccatctccaaaccccccacggcggcgcccttcaccaaggaagcgccgaccacggagcccttcgtgtcacggttcgcctccggcgaacctcgcaagggcgcggacatccttgtggaggcgctggagaggcagggcgtgacgacggtgttcgcgtaccccggcggtgcgtcgatggagatccaccaggcgctcacgcgctccgccgccatccgcaacgtgctcccgcgccacgagcagggcggcgtcttcgccgccgaaggctacgcgcgttcctccggcctccccggcgtctgcattgccacctccggccccggcgccaccaacctcgtgagcggcctcgccgacgctttaatggacagcgtcccagtcgtcgccatcaccggccaggtcgcccgccggatgatcggcaccgacgccttccaagaaaccccgatcgtggaggtgagcagatccatcacgaagcacaactacctcatcctcgacgtcgacgacatcccccgcgtcgtcgccgaggctttcttcgtcgccacctccggccgccccggtccggtcctcatcgacattcccaaagacgttcagcagcaactcgccgtgcctaattgggacgagcccgttaacctccccggttacctcgccaggctgcccaggccccccgccgaggcccaattggaacacattgtcagactcatcatggaggcccaaaagcccgttctctacgtcggcggtggcagtttgaattccagtgctgaattgaggcgctttgttgaactcactggtattcccgttgctagcactttaatgggtcttggaacttttcctattggtgatgaatattcccttcagatgctgggtatgcatggtactgtttatgctaactatgctgttgacaatagtgatttgttgcttgcctttggggtaaggtttgatgaccgtgttactgggaagcttgaggcttttgctagtagggctaagattgttcacattgatattgattctgccgagattgggaagaacaagcaggcgcacgtgtcggtttgcgcggatttgaagttggccttgaagggaattaatatgattttggaggagaaaggagtggagggtaagtttgatcttggaggttggagagaagagattaatgtgcagaaacacaagtttccattgggttacaagacattccaggacgcgatttctccgcagcatgctatcgaggttcttgatgagttgactaatggagatgctattgttagtactggggttgggcagcatcaaatgtgggctgcgcagttttacaagtacaagagaccgaggcagtggttgacctcagggggtcttggagccatgggttttggattgcctgcggctattggtgctgctgttgctaaccctggggctgttgtggttgacattgatggggatggtagtttcatcatgaatgttcaggagttggccactataagagtggagaatctcccagttaagatattgttgttgaacaatcagcatttgggtatggtggttcagttggaggataggttctacaagtccaatagagctcacacctatcttggagatccgtctagcgagagcgagatattcccaaacatgctcaagtttgctgatgcttgtgggataccggcagcgcgagtgacgaagaaggaagagcttagagcggcaattcagagaatgttggacacccctggcccctaccttcttgatgtcattgtgccccatcaggagcatgtgttgccgatgattcccagtaatggatccttcaaggatgtgataactgagggtgatggtagaacgaggtactgattgcctagaccaaatgttccttgatgcttgttttgtacaatatatataagataatgctgtcctagttgcaggatttggcctgtggtgagcatcatagtctgtagtagttttggtagcaagacattttattttccttttatttaacttactacatgcagtagcatctatctatctctgtagtctgatatctcctgttgtctgtattgtgccgttggattttttgctgtagtgagactgaaaatgatgtgctagtaataatatttctgttagaaatctaagtagagaatctgttgaagaagtcaaaagctaatggaatcaggttacatattcaatgtttttctttttttagcggttggtagacgtgtagattcaacttctcttggagctcacctaggcaatcagtaaaatgcatattccttttttaacttgccatttatttacttttagtggaaattgtgaccaatttgttcatgtagaacggatttggaccattgcgtccacaaaacgtctcttttgctcgatcttcacaaagcgataccgaaatccagagatagttttcaaaagtcagaaatggcaaagttataaatagtaaaacagaatagatgctgtaatcgacttcaataacaagtggcatcacgtttctagttctagacccatcagctgggccggcccagctgatgatcccggtgaagttcctattccgaagttcctattctccagaaagtataggaacttcactagagcttgcggccgcgcatgctgacttaatcagctaacgccactcgagggggggcccggtaccgg

SEQ ID NO: 1225 - DNA, 8131 bp, Artificial sequence
  PHP37589A
cgcgccggtacccgggtaccgagctcactagacgcggtgaaattacctaattaacaccggtgtttatcaaacaagtttgtacaaaaaagcaggctccggccagaatggcccggaccgggttaccgaattctagaaatccgtcaacatggtggagcacgacactctcgtctactccaagaatatcaaagatacagtctcagaagaccaaagggctattgagacttttcaacaaagggtaatatcgggaaacctcctcggattccattgcccagctatctgtcacttcatcaaaaggacagtagaaaaggaaggtggcacctacaaatgccatcattgcgataaaggaaaggctatcgttcaagatgcctctgccgacagtggtcccaaagatggacccccacccacgaggagcatcgtggaaaaagaagacgttccaaccacgtcttcaaagcaagtggattgatgtgatatctccactgacgtaagggatgacgcacaatcccactagactctatcagtgatagagtgtatataagactctatcagtgatagagtgaactctatcagtgatagagttgtacttatttttacaacaattaccaacaacaacaaacaacaaacaacattacaattactatttacaattacagtcgacccgggatccatggcctcctccgaggacgtcatcaaggagttcatgcgcttcaaggtgcgcatggagggctccgtgaacggccacgagttcgagatcgagggcgagggcgagggccgcccctacgagggcacccagaccgccaagctgaaggtgaccaagggcggccccctgcccttcgcctgggacatcctgtccccccagttccagtacggctccaaggtgtacgtgaagcaccccgccgacatccccgactacaagaagctgtccttccccgagggcttcaagtgggagcgcgtgatgaacttcgaggacggcggcgtggtgaccgtgacccaggactcctccctgcaggacggctccttcatctacaaggtgaagttcatcggcgtgaacttcccctccgacggccccgtaatgcagaagaagactatgggctgggaggcctccaccgagcgcctgtacccccgcgacggcgtgctgaagggcgagatccacaaggccctgaagctgaaggacggcggccactacctggtggagttcaagtccatctacatggccaagaagcccgtgcagctgcccggctactactacgtggactccaagctggacatcacctcccacaacgaggactacaccatcgtggagcagtacgagcgcgccgagggccgccaccacctgttcctgtagcggccccgctgaaatcaccagtctctctctacaaatctatctctctctataataatgtgtgagtagttcccagataagggaattagggttcttatagggtttcgctcatgtgttgagcatataagaaacccttagtatgtatttgtatttgtaaaatacttctatcaataaaatttctaattcctaaaaccaaaatccagtggcgagctcgagggtttacttattttgtgggtatctatacttttattagatttttaatcaggctcctgatttctttttatttcgattgaattcctgaacttgtattattcagtagatcgaataaattataaaaagataaaatcataaaataatattttatcctatcaatcatattaaagcaatgaatatgtaaaattaatcttatctttattttaaaaaatcatataggtttagtatttttttaaaaataaagataggattagttttactattcactgcttattacttttaaaaaaatcataaaggtttagtatttttttaaaataaatataggaatagttttactattcactgctttaatagaaaaatagtttaaaatttaagatagttttaatcccagcatttgccacgtttgaacgtgagccgaaacgatgtcgttacattatcttaacctagctgaaacgatgtcgtcataatatcgccaaatgccaactggactacgtcgaacccacaaatcccacaaagcgcgtgaaatcaaatcgctcaaaccacaaaaaagaacaacgcgtttgttacacgctcaatcccacgcgagtagagcacagtaaccttcaaataagcgaatggggcataatcagaaatccgaaataaacctaggggcattatcggaaatgaaaagtagctcactcaatataaaaatctaggaaccctagttttcgttatcactctgtgctccctcgctctatttctcagtctctgtgtttgcggctgaggattccgaacgagtgaccttcttcgtttctcgcaaaggtaacagcctctgctcttgtctcttcgattcgatctatgcctgtctcttatttacgatgatgtttcttcggttatgtttttttatttatgctttatgctgttgatgttcggttgtttgtttcgctttgtttttgtggttcagttttttaggattcttttggtttttgaatcgattaatcggaagagattttcgagttatttggtgtgttggaggtgaatcttttttttgaggtcatagatctgttgtatttgtgttataaacatgcgactttgtatgattttttacgaggttatgatgttctggttgttttattatgaatctgttgagacagaaccatgatttttgttgatgttcgtttacactattaaaggtttgttttaacaggattaaaagttttttaagcatgttgaaggagtcttgtagatatgtaaccgtcgatagtttttttgtgggtttgttcacatgttatcaagcttaatcttttactatgtatgcgaccatatctggatccagcaaaggcgattttttaattccttgtgaaacttttgtaatatgaagttgaaattttgttattggtaaactataaatgtgtgaagttggagtatacctttaccttcttatttggctttgtgatagtttaatttatatgtattttgagttctgacttgtatttctttgaattgattctagtttaagtaatccatggccagactcgacaagagcaaggtgatcaacagcgcactggagctgctgaacgaggtcggaatcgaaggcctcacaacccgtaagctcgcccagaagctcggggttgagcagcctacattgtactggcacgtcaagaacaagcgagctctgctagacgctatggccattgagatgctcgataggcacgctacccactactgccctttggaaggggaaagctggcaagacttcttgaggaacaacgctaagtccatgagatgtgctttgctcagtcaccgtgatggagccaaggtctgtctaggtacgggcttcacggagcaacagtatgaaactgctgagaacagccttgccttcctgtgccaacaaggtttctcccttgagcatgccatgtacgcaatgcaagctgctgggatctacactctgggttgcgtcttgctggatcaagagctgcaagtcgctaaggaggagagggaaacacctactactgatagtatgccgccactggttcgacaagctctggaactcaaggatcaccaaggtgcagagccagccttcctgttcggccttgaactgatcatatgcggattggagaagcagctgaagtgtgaaagtgggtcttaatgatagctgcaggcatgccgctgaaatcaccagtctctctctacaaatctatctctctctataataatgtgtgagtagttcccagataagggaattagggttcttatagggtttcgctcatgtgttgagcatataagaaacccttagtatgtatttgtatttgtaaaatacttctatcaataaaatttctaattcctaaaaccaaaatccagtggcgagctcgagcccgggcacccagctttcttgtacaaagtggttcgataaacactagtaacggccgccagtgtgctggaattcgcccttcccaagctttgctctagatcaaactcacatccaaacataacatggatatcttccttaccaatcatactaattattttgggttaaatattaatcattatttttaagatattaattaagaaattaaaagattttttaaaaaaatgtataaaattatattattcatgatttttcatacatttgattttgataataaatatattttttttaatttcttaaaaaatgttgcaagacacttattagacatagtcttgttctgtttacaaaagcattcatcatttaatacattaaaaaatatttaatactaacagtagaatcttcttgtgagtggtgtgggagtaggcaacctggcattgaaacgagagaaagagagtcagaaccagaagacaaataaaaagtatgcaacaaacaaatcaaaatcaaagggcaaaggctggggttggctcaattggttgctacattcaattttcaactcagtcaacggttgagattcactctgacttccccaatctaagccgcggatgcaaacggttgaatctaacccacaatccaatctcgttacttaggggcttttccgtcattaactcacccctgccacccggtttccctataaattggaactcaatgctcccctctaaactcgtatcgcttcagagttgagaccaagacacactcgttcatatatctctctgctcttctcttctcttctacctctcaaggtacttttcttctccctctaccaaatcctagattccgtggttcaatttcggatcttgcacttctggtttgctttgccttgctttttcctcaactgggtccatctaggatccatgtgaaactctactctttctttaatatctgcggaatacgcgtttgactttcagatctagtcgaaatcatttcataattgcctttctttcttttagcttatgagaaataaaatcactttttttttatttcaaaataaaccttgggccttgtgctgactgagatggggtttggtgattacagaattttagcgaattttgtaattgtacttgtttgtctgtagttttgttttgttttcttgtttctcatacattccttaggcttcaattttattcgagtataggtcacaataggaattcaaactttgagcaggggaattaatcccttccttcaaatccagtttgtttgtatatatgtttaaaaaatgaaacttttgctttaaattctattataactttttttatggctgaaatttttgcatgtgtctttgctctctgttgtaaatttactgtttaggtactaactctaggcttgttgtgcagtttttgaagtataacaacagaagttcctattccgaagttcctattctctagaaagtataggaacttccaccacacaacacaatggcggccaccgcttccagaaccacccgattctcttcttcctcttcacaccccaccttccccaaacgcattactagatccaccctccctctctctcatcaaaccctcaccaaacccaaccacgctctcaaaatcaaatgttccatctccaaaccccccacggcggcgcccttcaccaaggaagcgccgaccacggagcccttcgtgtcacggttcgcctccggcgaacctcgcaagggcgcggacatccttgtggaggcgctggagaggcagggcgtgacgacggtgttcgcgtaccccggcggtgcgtcgatggagatccaccaggcgctcacgcgctccgccgccatccgcaacgtgctcccgcgccacgagcagggcggcgtcttcgccgccgaaggctacgcgcgttcctccggcctccccggcgtctgcattgccacctccggccccggcgccaccaacctcgtgagcggcctcgccgacgctttaatggacagcgtcccagtcgtcgccatcaccggccaggtcgcccgccggatgatcggcaccgacgccttccaagaaaccccgatcgtggaggtgagcagatccatcacgaagcacaactacctcatcctcgacgtcgacgacatcccccgcgtcgtcgccgaggctttcttcgtcgccacctccggccgccccggtccggtcctcatcgacattcccaaagacgttcagcagcaactcgccgtgcctaattgggacgagcccgttaacctccccggttacctcgccaggctgcccaggccccccgccgaggcccaattggaacacattgtcagactcatcatggaggcccaaaagcccgttctctacgtcggcggtggcagtttgaattccagtgctgaattgaggcgctttgttgaactcactggtattcccgttgctagcactttaatgggtcttggaacttttcctattggtgatgaatattcccttcagatgctgggtatgcatggtactgtttatgctaactatgctgttgacaatagtgatttgttgcttgcctttggggtaaggtttgatgaccgtgttactgggaagcttgaggcttttgctagtagggctaagattgttcacattgatattgattctgccgagattgggaagaacaagcaggcgcacgtgtcggtttgcgcggatttgaagttggccttgaagggaattaatatgattttggaggagaaaggagtggagggtaagtttgatcttggaggttggagagaagagattaatgtgcagaaacacaagtttccattgggttacaagacattccaggacgcgatttctccgcagcatgctatcgaggttcttgatgagttgactaatggagatgctattgttagtactggggttgggcagcatcaaatgtgggctgcgcagttttacaagtacaagagaccgaggcagtggttgacctcagggggtcttggagccatgggttttggattgcctgcggctattggtgctgctgttgctaaccctggggctgttgtggttgacattgatggggatggtagtttcatcatgaatgttcaggagttggccactataagagtggagaatctcccagttaagatattgttgttgaacaatcagcatttgggtatggtggttcagttggaggataggttctacaagtccaatagagctcacacctatcttggagatccgtctagcgagagcgagatattcccaaacatgctcaagtttgctgatgcttgtgggataccggcagcgcgagtgacgaagaaggaagagcttagagcggcaattcagagaatgttggacacccctggcccctaccttcttgatgtcattgtgccccatcaggagcatgtgttgccgatgattcccagtaatggatccttcaaggatgtgataactgagggtgatggtagaacgaggtactgattgcctagaccaaatgttccttgatgcttgttttgtacaatatatataagataatgctgtcctagttgcaggatttggcctgtggtgagcatcatagtctgtagtagttttggtagcaagacattttattttccttttatttaacttactacatgcagtagcatctatctatctctgtagtctgatatctcctgttgtctgtattgtgccgttggattttttgctgtagtgagactgaaaatgatgtgctagtaataatatttctgttagaaatctaagtagagaatctgttgaagaagtcaaaagctaatggaatcaggttacatattcaatgtttttctttttttagcggttggtagacgtgtagattcaacttctcttggagctcacctaggcaatcagtaaaatgcatattccttttttaacttgccatttatttacttttagtggaaattgtgaccaatttgttcatgtagaacggatttggaccattgcgtccacaaaacgtctcttttgctcgatcttcacaaagcgataccgaaatccagagatagttttcaaaagtcagaaatggcaaagttataaatagtaaaacagaatagatgctgtaatcgacttcaataacaagtggcatcacgtttctagttctagacccatcagctgggccggcccagctgatgatcccggtgaagttcctattccgaagttcctattctccagaaagtataggaacttcactagagcttgcggccgcgcatgctgacttaatcagctaacgccactcgagggggggcccggtaccgg

SEQ ID NO: 1226 - DNA, 8201 bp, Artificial sequence
  PHP39389A
cgcgccggtacccgggtaccgagctcactagacgcggtgaaattacctaattaacaccggtgtttatcaaacaagtttgtacaaaaaagcaggctccggccagaatggcccggaccgggttaccgaattctagaaatccgtcaacatggtggagcacgacactctcgtctactccaagaatatcaaagatacagtctcagaagaccaaagggctattgagacttttcaacaaagggtaatatcgggaaacctcctcggattccattgcccagctatctgtcacttcatcaaaaggacagtagaaaaggaaggtggcacctacaaatgccatcattgcgataaaggaaaggctatcgttcaagatgcctctgccgacagtggtcccaaagatggacccccacccacgaggagcatcgtggaaaaagaagacgttccaaccacgtcttcaaagcaagtggattgatgtgatatctccactgacgtaagggatgacgcacaatcccactagactctatcagtgatagagtgtatataagactctatcagtgatagagtgaactctatcagtgatagagttgtacttatttttacaacaattaccaacaacaacaaacaacaaacaacattacaattactatttacaattacagtcgacatggcctcctccgaggacgtcatcaaggagttcatgcgcttcaaggtgcgcatggagggctccgtgaacggccacgagttcgagatcgagggcgagggcgagggccgcccctacgagggcacccagaccgccaagctgaaggtgaccaagggcggccccctgcccttcgcctgggacatcctgtccccccagttccagtacggctccaaggtgtacgtgaagcaccccgccgacatccccgactacaagaagctgtccttccccgagggcttcaagtgggagcgcgtgatgaacttcgaggacggcggcgtggtgaccgtgacccaggactcctccctgcaggacggctccttcatctacaaggtgaagttcatcggcgtgaacttcccctccgacggccccgtaatgcagaagaagactatgggctgggaggcctccaccgagcgcctgtacccccgcgacggcgtgctgaagggcgagatccacaaggccctgaagctgaaggacggcggccactacctggtggagttcaagtccatctacatggccaagaagcccgtgcagctgcccggctactactacgtggactccaagctggacatcacctcccacaacgaggactacaccatcgtggagcagtacgagcgcgccgagggccgccaccacctgttcctgtagcggccccgctgaaatcaccagtctctctctacaaatctatctctctctataataatgtgtgagtagttcccagataagggaattagggttcttatagggtttcgctcatgtgttgagcatataagaaacccttagtatgtatttgtatttgtaaaatacttctatcaataaaatttctaattcctaaaaccaaaatccagtggcgagctcgagtctagacccgggtttacttattttgtgggtatctatacttttattagatttttaatcaggctcctgatttctttttatttcgattgaattcctgaacttgtattattcagtagatcgaataaattataaaaagataaaatcataaaataatattttatcctatcaatcatattaaagcaatgaatatgtaaaattaatcttatctttattttaaaaaatcatataggtttagtatttttttaaaaataaagataggattagttttactattcactgcttattacttttaaaaaaatcataaaggtttagtatttttttaaaataaatataggaatagttttactattcactgctttaatagaaaaatagtttaaaatttaagatagttttaatcccagcatttgccacgtttgaacgtgagccgaaacgatgtcgttacattatcttaacctagctgaaacgatgtcgtcataatatcgccaaatgccaactggactacgtcgaacccacaaatcccacaaagcgcgtgaaatcaaatcgctcaaaccacaaaaaagaacaacgcgtttgttacacgctcaatcccacgcgagtagagcacagtaaccttcaaataagcgaatggggcataatcagaaatccgaaataaacctaggggcattatcggaaatgaaaagtagctcactcaatataaaaatctaggaaccctagttttcgttatcactctgtgctccctcgctctatttctcagtctctgtgtttgcggctgaggattccgaacgagtgaccttcttcgtttctcgcaaaggtaacagcctctgctcttgtctcttcgattcgatctatgcctgtctcttatttacgatgatgtttcttcggttatgtttttttatttatgctttatgctgttgatgttcggttgtttgtttcgctttgtttttgtggttcagttttttaggattcttttggtttttgaatcgattaatcggaagagattttcgagttatttggtgtgttggaggtgaatcttttttttgaggtcatagatctgttgtatttgtgttataaacatgcgactttgtatgattttttacgaggttatgatgttctggttgttttattatgaatctgttgagacagaaccatgatttttgttgatgttcgtttacactattaaaggtttgttttaacaggattaaaagttttttaagcatgttgaaggagtcttgtagatatgtaaccgtcgatagtttttttgtgggtttgttcacatgttatcaagcttaatcttttactatgtatgcgaccatatctggatccagcaaaggcgattttttaattccttgtgaaacttttgtaatatgaagttgaaattttgttattggtaaactataaatgtgtgaagttggagtatacctttaccttcttatttggctttgtgatagtttaatttatatgtattttgagttctgacttgtatttctttgaattgattctagtttaagtaatccatggccagactcgacaagagcaaggtgatcaacagcgcactggagctgctgaacgaggtcggaatcgaaggcctcacaacccgtaagctcgcccagaagctcggggttgagcagcctacattgtactggcacgtcaagaacaagcgagctctgctagacgctatggccatcgagatgctcgatccccacgctccccacttgttacccttggaaggggcaagctggcaagacttcttgaggaacaacgctaagtccatgagatgcgctttgctcagtcaccgtgatggagccaaggtctgtctaggtacgggcttcacggagcaacagtatgaaactgctgagaacagccttgccttcctgacacaacaaggtttctcccttgagaacgccctctacgcaatgcaagctgttgggatctacactctgggttgcgcgttgctggatcaagagctgcaagtcgctaaggaggagagggaaacacctactactgatagtatgccgccactggttcgacaagctctggaactcaaggatcaccaaggtgcagagccagccttcctgttcggccttgaactgatcataagcggattggagaagcagctgaagcgtgaaagtgggtcttaatgataggcggccgctaaagaaggagtgcgtcgaagcagatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatcgatggatgggcacccagctttcttgtacaaagtggttcgataaacactagtaacggccgccagtgtgctggaattcgcccttcccaagctttgctctagatcaaactcacatccaaacataacatggatatcttccttaccaatcatactaattattttgggttaaatattaatcattatttttaagatattaattaagaaattaaaagattttttaaaaaaatgtataaaattatattattcatgatttttcatacatttgattttgataataaatatattttttttaatttcttaaaaaatgttgcaagacacttattagacatagtcttgttctgtttacaaaagcattcatcatttaatacattaaaaaatatttaatactaacagtagaatcttcttgtgagtggtgtgggagtaggcaacctggcattgaaacgagagaaagagagtcagaaccagaagacaaataaaaagtatgcaacaaacaaatcaaaatcaaagggcaaaggctggggttggctcaattggttgctacattcaattttcaactcagtcaacggttgagattcactctgacttccccaatctaagccgcggatgcaaacggttgaatctaacccacaatccaatctcgttacttaggggcttttccgtcattaactcacccctgccacccggtttccctataaattggaactcaatgctcccctctaaactcgtatcgcttcagagttgagaccaagacacactcgttcatatatctctctgctcttctcttctcttctacctctcaaggtacttttcttctccctctaccaaatcctagattccgtggttcaatttcggatcttgcacttctggtttgctttgccttgctttttcctcaactgggtccatctaggatccatgtgaaactctactctttctttaatatctgcggaatacgcgtttgactttcagatctagtcgaaatcatttcataattgcctttctttcttttagcttatgagaaataaaatcactttttttttatttcaaaataaaccttgggccttgtgctgactgagatggggtttggtgattacagaattttagcgaattttgtaattgtacttgtttgtctgtagttttgttttgttttcttgtttctcatacattccttaggcttcaattttattcgagtataggtcacaataggaattcaaactttgagcaggggaattaatcccttccttcaaatccagtttgtttgtatatatgtttaaaaaatgaaacttttgctttaaattctattataactttttttatggctgaaatttttgcatgtgtctttgctctctgttgtaaatttactgtttaggtactaactctaggcttgttgtgcagtttttgaagtataacaacagaagttcctattccgaagttcctattctctagaaagtataggaacttccaccacacaacacaatggcggccaccgcttccagaaccacccgattctcttcttcctcttcacaccccaccttccccaaacgcattactagatccaccctccctctctctcatcaaaccctcaccaaacccaaccacgctctcaaaatcaaatgttccatctccaaaccccccacggcggcgcccttcaccaaggaagcgccgaccacggagcccttcgtgtcacggttcgcctccggcgaacctcgcaagggcgcggacatccttgtggaggcgctggagaggcagggcgtgacgacggtgttcgcgtaccccggcggtgcgtcgatggagatccaccaggcgctcacgcgctccgccgccatccgcaacgtgctcccgcgccacgagcagggcggcgtcttcgccgccgaaggctacgcgcgttcctccggcctccccggcgtctgcattgccacctccggccccggcgccaccaacctcgtgagcggcctcgccgacgctttaatggacagcgtcccagtcgtcgccatcaccggccaggtcgcccgccggatgatcggcaccgacgccttccaagaaaccccgatcgtggaggtgagcagatccatcacgaagcacaactacctcatcctcgacgtcgacgacatcccccgcgtcgtcgccgaggctttcttcgtcgccacctccggccgccccggtccggtcctcatcgacattcccaaagacgttcagcagcaactcgccgtgcctaattgggacgagcccgttaacctccccggttacctcgccaggctgcccaggccccccgccgaggcccaattggaacacattgtcagactcatcatggaggcccaaaagcccgttctctacgtcggcggtggcagtttgaattccagtgctgaattgaggcgctttgttgaactcactggtattcccgttgctagcactttaatgggtcttggaacttttcctattggtgatgaatattcccttcagatgctgggtatgcatggtactgtttatgctaactatgctgttgacaatagtgatttgttgcttgcctttggggtaaggtttgatgaccgtgttactgggaagcttgaggcttttgctagtagggctaagattgttcacattgatattgattctgccgagattgggaagaacaagcaggcgcacgtgtcggtttgcgcggatttgaagttggccttgaagggaattaatatgattttggaggagaaaggagtggagggtaagtttgatcttggaggttggagagaagagattaatgtgcagaaacacaagtttccattgggttacaagacattccaggacgcgatttctccgcagcatgctatcgaggttcttgatgagttgactaatggagatgctattgttagtactggggttgggcagcatcaaatgtgggctgcgcagttttacaagtacaagagaccgaggcagtggttgacctcagggggtcttggagccatgggttttggattgcctgcggctattggtgctgctgttgctaaccctggggctgttgtggttgacattgatggggatggtagtttcatcatgaatgttcaggagttggccactataagagtggagaatctcccagttaagatattgttgttgaacaatcagcatttgggtatggtggttcagttggaggataggttctacaagtccaatagagctcacacctatcttggagatccgtctagcgagagcgagatattcccaaacatgctcaagtttgctgatgcttgtgggataccggcagcgcgagtgacgaagaaggaagagcttagagcggcaattcagagaatgttggacacccctggcccctaccttcttgatgtcattgtgccccatcaggagcatgtgttgccgatgattcccagtaatggatccttcaaggatgtgataactgagggtgatggtagaacgaggtactgattgcctagaccaaatgttccttgatgcttgttttgtacaatatatataagataatgctgtcctagttgcaggatttggcctgtggtgagcatcatagtctgtagtagttttggtagcaagacattttattttccttttatttaacttactacatgcagtagcatctatctatctctgtagtctgatatctcctgttgtctgtattgtgccgttggattttttgctgtagtgagactgaaaatgatgtgctagtaataatatttctgttagaaatctaagtagagaatctgttgaagaagtcaaaagctaatggaatcaggttacatattcaatgtttttctttttttagcggttggtagacgtgtagattcaacttctcttggagctcacctaggcaatcagtaaaatgcatattccttttttaacttgccatttatttacttttagtggaaattgtgaccaatttgttcatgtagaacggatttggaccattgcgtccacaaaacgtctcttttgctcgatcttcacaaagcgataccgaaatccagagatagttttcaaaagtcagaaatggcaaagttataaatagtaaaacagaatagatgctgtaatcgacttcaataacaagtggcatcacgtttctagttctagacccatcagctgggccggcccagctgatgatcccggtgaagttcctattccgaagttcctattctccagaaagtataggaacttcactagagcttgcggccgcgcatgctgacttaatcagctaacgccactcgagggggggcccggtaccgg

SEQ ID NO: 1227 - DNA, 8201 bp, Artificial sequence
  PHP39390A
cgcgccggtacccgggtaccgagctcactagacgcggtgaaattacctaattaacaccggtgtttatcaaacaagtttgtacaaaaaagcaggctccggccagaatggcccggaccgggttaccgaattctagaaatccgtcaacatggtggagcacgacactctcgtctactccaagaatatcaaagatacagtctcagaagaccaaagggctattgagacttttcaacaaagggtaatatcgggaaacctcctcggattccattgcccagctatctgtcacttcatcaaaaggacagtagaaaaggaaggtggcacctacaaatgccatcattgcgataaaggaaaggctatcgttcaagatgcctctgccgacagtggtcccaaagatggacccccacccacgaggagcatcgtggaaaaagaagacgttccaaccacgtcttcaaagcaagtggattgatgtgatatctccactgacgtaagggatgacgcacaatcccactagactctatcagtgatagagtgtatataagactctatcagtgatagagtgaactctatcagtgatagagttgtacttatttttacaacaattaccaacaacaacaaacaacaaacaacattacaattactatttacaattacagtcgacatggcctcctccgaggacgtcatcaaggagttcatgcgcttcaaggtgcgcatggagggctccgtgaacggccacgagttcgagatcgagggcgagggcgagggccgcccctacgagggcacccagaccgccaagctgaaggtgaccaagggcggccccctgcccttcgcctgggacatcctgtccccccagttccagtacggctccaaggtgtacgtgaagcaccccgccgacatccccgactacaagaagctgtccttccccgagggcttcaagtgggagcgcgtgatgaacttcgaggacggcggcgtggtgaccgtgacccaggactcctccctgcaggacggctccttcatctacaaggtgaagttcatcggcgtgaacttcccctccgacggccccgtaatgcagaagaagactatgggctgggaggcctccaccgagcgcctgtacccccgcgacggcgtgctgaagggcgagatccacaaggccctgaagctgaaggacggcggccactacctggtggagttcaagtccatctacatggccaagaagcccgtgcagctgcccggctactactacgtggactccaagctggacatcacctcccacaacgaggactacaccatcgtggagcagtacgagcgcgccgagggccgccaccacctgttcctgtagcggccccgctgaaatcaccagtctctctctacaaatctatctctctctataataatgtgtgagtagttcccagataagggaattagggttcttatagggtttcgctcatgtgttgagcatataagaaacccttagtatgtatttgtatttgtaaaatacttctatcaataaaatttctaattcctaaaaccaaaatccagtggcgagctcgagtctagacccgggtttacttattttgtgggtatctatacttttattagatttttaatcaggctcctgatttctttttatttcgattgaattcctgaacttgtattattcagtagatcgaataaattataaaaagataaaatcataaaataatattttatcctatcaatcatattaaagcaatgaatatgtaaaattaatcttatctttattttaaaaaatcatataggtttagtatttttttaaaaataaagataggattagttttactattcactgcttattacttttaaaaaaatcataaaggtttagtatttttttaaaataaatataggaatagttttactattcactgctttaatagaaaaatagtttaaaatttaagatagttttaatcccagcatttgccacgtttgaacgtgagccgaaacgatgtcgttacattatcttaacctagctgaaacgatgtcgtcataatatcgccaaatgccaactggactacgtcgaacccacaaatcccacaaagcgcgtgaaatcaaatcgctcaaaccacaaaaaagaacaacgcgtttgttacacgctcaatcccacgcgagtagagcacagtaaccttcaaataagcgaatggggcataatcagaaatccgaaataaacctaggggcattatcggaaatgaaaagtagctcactcaatataaaaatctaggaaccctagttttcgttatcactctgtgctccctcgctctatttctcagtctctgtgtttgcggctgaggattccgaacgagtgaccttcttcgtttctcgcaaaggtaacagcctctgctcttgtctcttcgattcgatctatgcctgtctcttatttacgatgatgtttcttcggttatgtttttttatttatgctttatgctgttgatgttcggttgtttgtttcgctttgtttttgtggttcagttttttaggattcttttggtttttgaatcgattaatcggaagagattttcgagttatttggtgtgttggaggtgaatcttttttttgaggtcatagatctgttgtatttgtgttataaacatgcgactttgtatgattttttacgaggttatgatgttctggttgttttattatgaatctgttgagacagaaccatgatttttgttgatgttcgtttacactattaaaggtttgttttaacaggattaaaagttttttaagcatgttgaaggagtcttgtagatatgtaaccgtcgatagtttttttgtgggtttgttcacatgttatcaagcttaatcttttactatgtatgcgaccatatctggatccagcaaaggcgattttttaattccttgtgaaacttttgtaatatgaagttgaaattttgttattggtaaactataaatgtgtgaagttggagtatacctttaccttcttatttggctttgtgatagtttaatttatatgtattttgagttctgacttgtatttctttgaattgattctagtttaagtaatccatggccagactcgacaagagcaaggtgatcaacagcgcactggagctgctgaacgaggtcggaatcgaaggcctcacaacccgtaagctcgcccagaagctcggggttgagcagcctacattgtactggcacgtcaagaacaagcgagctctgctagacgctatggccattgagatgctcgatcgccacgctatacacttgttacccttggaaggggaaagctggcaagacttcttgaggaacaacgctaagtccatgagatgcgctttgctcagtcaccgtgatggagccaaggtctgtctaggtacgggcttcacggagcaacaatatgaaactgcggagaaccgccttgccttcctgacacaacaaggtttctcccttgagaacgccctctacgcatggcaagcagtggggatctacactctgggttgtgtcttgctggatcaagagctgcaagtcgctaaggaggagagggaaacacctactactgatagtatgccgccactggttcgacaagctctggaactcaaggatcaccaaggtgcagagccagccttcctgttcggccttgaactgatcataggcggattggagaagcagctgaagagtgaaagtgggtcttaatgataggcggccgctaaagaaggagtgcgtcgaagcagatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatcgatggatgggcacccagctttcttgtacaaagtggttcgataaacactagtaacggccgccagtgtgctggaattcgcccttcccaagctttgctctagatcaaactcacatccaaacataacatggatatcttccttaccaatcatactaattattttgggttaaatattaatcattatttttaagatattaattaagaaattaaaagattttttaaaaaaatgtataaaattatattattcatgatttttcatacatttgattttgataataaatatattttttttaatttcttaaaaaatgttgcaagacacttattagacatagtcttgttctgtttacaaaagcattcatcatttaatacattaaaaaatatttaatactaacagtagaatcttcttgtgagtggtgtgggagtaggcaacctggcattgaaacgagagaaagagagtcagaaccagaagacaaataaaaagtatgcaacaaacaaatcaaaatcaaagggcaaaggctggggttggctcaattggttgctacattcaattttcaactcagtcaacggttgagattcactctgacttccccaatctaagccgcggatgcaaacggttgaatctaacccacaatccaatctcgttacttaggggcttttccgtcattaactcacccctgccacccggtttccctataaattggaactcaatgctcccctctaaactcgtatcgcttcagagttgagaccaagacacactcgttcatatatctctctgctcttctcttctcttctacctctcaaggtacttttcttctccctctaccaaatcctagattccgtggttcaatttcggatcttgcacttctggtttgctttgccttgctttttcctcaactgggtccatctaggatccatgtgaaactctactctttctttaatatctgcggaatacgcgtttgactttcagatctagtcgaaatcatttcataattgcctttctttcttttagcttatgagaaataaaatcactttttttttatttcaaaataaaccttgggccttgtgctgactgagatggggtttggtgattacagaattttagcgaattttgtaattgtacttgtttgtctgtagttttgttttgttttcttgtttctcatacattccttaggcttcaattttattcgagtataggtcacaataggaattcaaactttgagcaggggaattaatcccttccttcaaatccagtttgtttgtatatatgtttaaaaaatgaaacttttgctttaaattctattataactttttttatggctgaaatttttgcatgtgtctttgctctctgttgtaaatttactgtttaggtactaactctaggcttgttgtgcagtttttgaagtataacaacagaagttcctattccgaagttcctattctctagaaagtataggaacttccaccacacaacacaatggcggccaccgcttccagaaccacccgattctcttcttcctcttcacaccccaccttccccaaacgcattactagatccaccctccctctctctcatcaaaccctcaccaaacccaaccacgctctcaaaatcaaatgttccatctccaaaccccccacggcggcgcccttcaccaaggaagcgccgaccacggagcccttcgtgtcacggttcgcctccggcgaacctcgcaagggcgcggacatccttgtggaggcgctggagaggcagggcgtgacgacggtgttcgcgtaccccggcggtgcgtcgatggagatccaccaggcgctcacgcgctccgccgccatccgcaacgtgctcccgcgccacgagcagggcggcgtcttcgccgccgaaggctacgcgcgttcctccggcctccccggcgtctgcattgccacctccggccccggcgccaccaacctcgtgagcggcctcgccgacgctttaatggacagcgtcccagtcgtcgccatcaccggccaggtcgcccgccggatgatcggcaccgacgccttccaagaaaccccgatcgtggaggtgagcagatccatcacgaagcacaactacctcatcctcgacgtcgacgacatcccccgcgtcgtcgccgaggctttcttcgtcgccacctccggccgccccggtccggtcctcatcgacattcccaaagacgttcagcagcaactcgccgtgcctaattgggacgagcccgttaacctccccggttacctcgccaggctgcccaggccccccgccgaggcccaattggaacacattgtcagactcatcatggaggcccaaaagcccgttctctacgtcggcggtggcagtttgaattccagtgctgaattgaggcgctttgttgaactcactggtattcccgttgctagcactttaatgggtcttggaacttttcctattggtgatgaatattcccttcagatgctgggtatgcatggtactgtttatgctaactatgctgttgacaatagtgatttgttgcttgcctttggggtaaggtttgatgaccgtgttactgggaagcttgaggcttttgctagtagggctaagattgttcacattgatattgattctgccgagattgggaagaacaagcaggcgcacgtgtcggtttgcgcggatttgaagttggccttgaagggaattaatatgattttggaggagaaaggagtggagggtaagtttgatcttggaggttggagagaagagattaatgtgcagaaacacaagtttccattgggttacaagacattccaggacgcgatttctccgcagcatgctatcgaggttcttgatgagttgactaatggagatgctattgttagtactggggttgggcagcatcaaatgtgggctgcgcagttttacaagtacaagagaccgaggcagtggttgacctcagggggtcttggagccatgggttttggattgcctgcggctattggtgctgctgttgctaaccctggggctgttgtggttgacattgatggggatggtagtttcatcatgaatgttcaggagttggccactataagagtggagaatctcccagttaagatattgttgttgaacaatcagcatttgggtatggtggttcagttggaggataggttctacaagtccaatagagctcacacctatcttggagatccgtctagcgagagcgagatattcccaaacatgctcaagtttgctgatgcttgtgggataccggcagcgcgagtgacgaagaaggaagagcttagagcggcaattcagagaatgttggacacccctggcccctaccttcttgatgtcattgtgccccatcaggagcatgtgttgccgatgattcccagtaatggatccttcaaggatgtgataactgagggtgatggtagaacgaggtactgattgcctagaccaaatgttccttgatgcttgttttgtacaatatatataagataatgctgtcctagttgcaggatttggcctgtggtgagcatcatagtctgtagtagttttggtagcaagacattttattttccttttatttaacttactacatgcagtagcatctatctatctctgtagtctgatatctcctgttgtctgtattgtgccgttggattttttgctgtagtgagactgaaaatgatgtgctagtaataatatttctgttagaaatctaagtagagaatctgttgaagaagtcaaaagctaatggaatcaggttacatattcaatgtttttctttttttagcggttggtagacgtgtagattcaacttctcttggagctcacctaggcaatcagtaaaatgcatattccttttttaacttgccatttatttacttttagtggaaattgtgaccaatttgttcatgtagaacggatttggaccattgcgtccacaaaacgtctcttttgctcgatcttcacaaagcgataccgaaatccagagatagttttcaaaagtcagaaatggcaaagttataaatagtaaaacagaatagatgctgtaatcgacttcaataacaagtggcatcacgtttctagttctagacccatcagctgggccggcccagctgatgatcccggtgaagttcctattccgaagttcctattctccagaaagtataggaacttcactagagcttgcggccgcgcatgctgacttaatcagctaacgccactcgagggggggcccggtaccgg

SEQ ID NO: 1228 - protein, 208 aa, Artificial sequence
  Sulfonylurea responsive repressor L6-3A09
MGSRLDKSKVINSALELLNEVGIEGLTTRKLAQKLGVEQPTLYWHVKNKRALLDALAIEMMDRHQTHLCPLEGESWQDFLRNNAKSMRCALLSHRDGAKVCLGTRWTEQMYEAAENMLAFLCQQGFSLENALYAVSAVRVFTLGCVLFDQESQVAKEERETPTTASMPPLVRQAWELKDHQGAEPAFLFGLELIICGLEKQLKCESGS

SEQ ID NO: 1229 - protein, 208 aa, Artificial sequence
  Sulfonylurea responsive repressor L7-4C06(E03)
  misc_feature (9)..(9): Xaa can be any naturally occurring amino acid
MGSRLDKSXVINSALELLNEVGIEGLTTRKLAQKLGVEQPTLYWHVKNKRALLDAMAIEMLDRHATHYCPLEGESWQDFLRNNAKSMRCALLSHRDGAKVCLGTGFTEQQYEAAENSLAFLCQQGFSLENALYAMQAVGIFTLGCVLLDQELQVAKEERETPTTDSMPPLVRQGLELKDHQGAEPAFLFGLELIICGLEKQLKCESGS

SEQ ID NO: 1230 - protein, 207 aa, Artificial sequence
  Sulfonylurea responsive repressor L10-84(B12)
MARLDKSKVINSALELLNEVGIEGLTTRKLAQKLGVEQPTLYWHVKNKRALLDAMAIEMLDRHAPHLSLLEGESWQDFLRNNAKSMRNALLSHRDGAKVCLGTGFTEQNYETAENSLAFLTQQGFSLENALYAWQALGIYTLGCALLDQELQVAKEERETPTTDSMPPLVRQALELKDHQGAEPAFLFGLELIIAGLEKQLKAESGS

SEQ ID NO: 1231 - protein, 207 aa, Artificial sequence
  Sulfonylurea responsive repressor L13-2-46(B10)
MARLDKSKVINSALELLNEVGIEGLTTRKLAQKLGVEQPTLYWHVKNKRALLDAMAIEMFDRHKTHYCPLEGESWQDFLRNRAKSMRNALLSHRDGAKVALGTGFTEQQYETMENCLAFLTQQGFSLENALYAMQAVGIYTLGCVLLDQELQVAKEERETPTTDSMPPLVRQAYELRDHQGAEPAFLFGLELIISGLEKQLKAESGS

SEQ ID NO: 1232 - protein, 207 aa, Artificial sequence
  Sulfonylurea responsive repressor L12-1-10
MARLDKSKVINSALELLNEVGIEGLTTRKLAQKLGVEQPTLYWHVKNKRALLDAMAFEMLDRHAIHFLPLEGASWQNFLRNTAKSMRNALLSHRDGAKVCLGTGFTERQYETAENRLAFLTQQGFSLEQALYAWQAVGIYTLGCVLLDQELQVAKEERETPTTDSMPPLVRQAWELKDHQGAEPAFLFGLELIISGLEKQLKAESGS

SEQ ID NO: 1233 - protein, 207 aa, Artificial sequence
  Sulfonylurea responsive repressor L13-2-23
MARLDKSKVINSALELLNEVGIEGLTTRKLAQKLGVEQPTLYWHVKNKRALLDAMAIEMLDRHAIHLLPLEGESWQDFLRNNAKSMRCALLSHRDGAKVCLGTGFTEQQYETAENRLAFLTQQGFSLENALYAWQAVGIYTLGCVLLDQELQVAKEERETPTTDSMPPLVRQALELKDHQGAEPAFLFGLELIIGGLEKQLKSESGS

SEQ ID NO: 1234 - DNA, 624 bp, Artificial sequence
  SuR L6-3A09 CDS
atgggatctagattagataaaagtaaagtgattaacagcgcattagagctgcttaatgaggtcggaatcgaaggtttaacaacccgtaaactcgcccagaagctaggtgtagagcagcctacattgtattggcatgtaaaaaataagcgagctctgctcgacgccttagccattgagatgatggataggcaccaaactcacttgtgccctttagaaggggaaagctggcaagattttttacgtaataatgctaaaagtatgagatgtgctttactaagccatcgcgatggagcaaaagtatgtttaggtacacgctggacagaacaaatgtatgaagctgctgaaaatatgttagcctttttatgccaacaaggtttttcactagagaatgcattatatgcagtgagtgctgtgagggtgtttactttaggttgcgtattgtttgatcaagagagccaagtcgctaaagaagaaagggaaacacctactactgctagtatgccgccattagtgcgacaagcttgggaattaaaggatcaccaaggtgcagagccagccttcttattcggccttgaattgatcatatgcggattagaaaaacaacttaaatgcgaaagtgggtct

SEQ ID NO: 1235 - DNA, 624 bp, Artificial sequence
  SuR L7-4C06(E03) CDS
atgggatctagattagataaaagtaaagtgattaacagcgcattagagctgcttawtgaggtcggaatcgaaggtttaacaacccgtaaactcgcccagaagctaggtgtagagcagcctacattgtattggcatgtaaaaaataagcgagctctgctcgacgcaatggccattgagatgctggataggcacgcgactcactattgccctttagaaggggaaagctggcaagattttttacgtaataacgctaaaagtatgagatgtgctttactaagtcatcgcgatggagcaaaagtatgtttaggtacaggctttacagaacagcaatatgaagctgccgaaaatagtctggcctttttatgccaacaaggtttttcactagagaacgcactgtatgcaatgcaggctgttggtatttttactttaggttgcgtattgttggatcaagagcttcaagtcgctaaagaagaaagggaaacacctactactgatagtatgccgccattagtccgacaaggtctggaattaaaggatcaccaaggtgcagagccagccttcttattcggccttgaattgatcatatgcggattagaaaaacaacttaaatgtgaaagtgggtct

SEQ ID NO: 1236 - DNA, 621 bp, Artificial sequence
  SuR L10-84(B12) CDS
atggccagactcgacaagagcaaggtgatcaacagcgcactggagctgctgaacgaggtcggaatcgaaggcctcacaacccgtaagctcgcccagaagctcggggttgagcagcctacattgtactggcacgtcaagaacaagcgagctctgctagacgctatggccattgagatgctcgatcgccacgctccccacttgagtctcttggaaggggaaagctggcaagacttcttgaggaacaacgctaagtccatgagaaacgctttgctcagtcaccgtgatggagccaaggtctgtctaggtacgggcttcacggagcaaaactatgaaactgctgagaacagccttgccttcctgacacaacaaggtttctcccttgagaacgccctctacgcatggcaagcactggggatctacactctgggttgcgcgttgctggatcaagagctgcaagtcgctaaggaggagagggaaacacctactactgatagtatgccgccactggttcgacaagctctggaactcaaggatcaccaaggtgcagagccagccttcctgttcggccttgaactgatcatagcaggattggagaagcagctgaaggccgaaagtgggtct

SEQ ID NO: 1237 - DNA, 621 bp, Artificial sequence
  SuR L13-2-46(D10) CDS
atggccagactcgacaagagcaaggtgatcaacagcgcactggagctgctgaacgaggtcggaatcgaaggcctcacaacccgtaagctcgcccagaagctcggggttgagcagcctacattgtactggcacgtcaagaacaagcgagctctgctagacgctatggccattgagatgttcgataggcacaagacccactactgtcctttggaaggggaaagctggcaagacttcttgaggaacagggctaagtccatgagaaatgctttgctcagtcaccgtgatggagccaaggtcgctctaggtacgggcttcacggagcaacagtatgaaactatggagaactgtcttgccttcctgacacaacaaggtttctcccttgagaacgccctctacgcaatgcaagctgttgggatctacactctgggttgcgtcttgctggatcaagagctgcaagtcgctaaggaggagagggaaacacctactactgatagtatgccgccactggttcgacaagcttacgaactcagagatcaccaaggtgcagagccagccttcctgttcggccttgaactgatcataagtggattggagaagcagctgaaggcagaaagtgggtct

SEQ ID NO: 1238 - DNA, 621 bp, Artificial sequence
  SuR L12-1-10 CDS
atggccagactcgacaagagcaaggtgatcaacagcgcactggagctgctgaacgaggtcggaatcgaaggcctcacaacccgtaagctcgcccagaagctcggggttgagcagcctacattgtactggcacgtcaagaacaagcgagctctgctagacgctatggccttcgagatgctcgatcgccacgctatacactttttaccattggaaggggcaagctggcaaaatttcttgaggaacaccgctaagtccatgagaaacgctttgctcagtcaccgtgatggagccaaggtctgtctaggtacgggcttcacggagcgacaatatgaaactgcggagaaccgccttgccttcctgacacaacaaggtttctcccttgagcaggccctctacgcatggcaagcagtggggatctacactctgggttgtgtcttgctggatcaagagctgcaagtcgctaaggaggagagggaaacacctactactgatagtatgccgccactggttcgacaagcttgggaactcaaggatcaccaaggtgcagagccagccttcctgttcggccttgaactgatcatatcaggattggagaagcagctgaaggcagaaagtgggtct

SEQ ID NO: 1239 - DNA, 621 bp, Artificial sequence
  SuR L13-2-23 CDS
atggccagactcgacaagagcaaggtgatcaacagcgcactggagctgctgaacgaggtcggaatcgaaggcctcacaacccgtaagctcgcccagaagctcggggttgagcagcctacattgtactggcacgtcaagaacaagcgagctctgctagacgctatggccattgagatgctcgatcgccacgctatacacttgttacccttggaaggggaaagctggcaagacttcttgaggaacaacgctaagtccatgagatgcgctttgctcagtcaccgtgatggagccaaggtctgtctaggtacgggcttcacggagcaacaatatgaaactgcggagaaccgccttgccttcctgacacaacaaggtttctcccttgagaacgccctctacgcatggcaagcagtggggatctacactctgggttgtgtcttgctggatcaagagctgcaagtcgctaaggaggagagggaaacacctactactgatagtatgccgccactggttcgacaagctctggaactcaaggatcaccaaggtgcagagccagccttcctgttcggccttgaactgatcataggcggattggagaagcagctgaagagtgaaagtgggtct

SEQ ID NO: 1240 - protein, 207 aa, Artificial sequence
  Sulfonylurea responsive repressor L7-1C3-A5
MARLDKSKVINSALELLNEVGIEGLTTRKLAQKLGVEQPTLYWHVKNKRALLDAMAIEMLDRHATHVCPLEGESWQDFLRNNAKIMRCALLSHRDGAKVCLGTGFTEQQYETAENSLAFLCQQGFSLEHALYAMQAAGIFTLGCVLLDQELQVAKEERETPTTDSMPPLVRQALELNDHQGAEPAFLFGLELIICGLEKQLKCESGS

SEQ ID NO: 1241 - protein, 207 aa, Artificial sequence
  Sulfonylurea responsive repressor L7-1F8-A11
MARLDKSKVINSALELLNEVGIEGLTTRKLAQKLGVEQPTLYWHVKNKRALLDAMAIEMLDRHATHYCPLEGESWQDFLRNNAKSMRCALLSHRDGAKVCLGTGFTEQQYETAENSLAFLCQQGFSLENALYAMQAVGIYTLGCVLLDQELQVAKEERETPTTDSMPPLVRQALELKDHQGAEPAFLFGLELIICGLEKQLKCESGS

SEQ ID NO: 1242 - protein, 207 aa, Artificial sequence
  Sulfonylurea responsive repressor L7-1G6-B2
MARLDKSKVINSALELLNEVGIEGLTTRKLAQKLGVEQPTLYWHVKNKRALLDAMAIEMLDRHATHYCPLEGESWQDFLRNNAKSMRCALLSHRDGAKVCLGTGFTEQQYETAENSMAFLCQQGFSLENALYAMQAVGIYTLGCVLLDQELQVAKEERETPTTDSMPPLVRQALELKDHQGAEPAFLFGLELIICGLEKQLKCESGS

SEQ ID NO: 1243 - protein, 207 aa, Artificial sequence
  Sulfonylurea responsive repressor L7-3E3-D1
MARLDKSKVINSALELLNEVGIEGLTTRKLAQKLGVEQPTLYWHVKNKRALLDAMAIEMLDRHATHYCPLEGESWQDFLRNNAKSMRCALLSHRDGAKVCLGTGFTEQQYETAENSLAFLCQQGFSLEHAMYAMQAAGIYTLGCVLLDQELQVAKEERETPTTDSMPPLVRQALELKDHQGAEPAFLFGLELIICGLEKQLKCESGS

SEQ ID NO: 1244 - DNA, 621 bp, Artificial sequence
  SuR L7-1C3-A5 comprising plant preferred codons
atggccagactcgacaagagcaaggtgatcaacagcgcactggagctgctgaacgaggtcggaatcgaaggcctcacaacccgtaaactcgcccagaagctcggggtagagcagcctacattgtattggcacgtcaagaacaagcgagctctgctagacgctatggccattgagatgctcgataggcacgctacccacgtgtgccctttggaaggggaaagctggcaagacttcttgaggaacaacgctaagatcatgagatgtgctttgctcagtcaccgtgatggagccaaggtctgtctaggtacaggcttcacggagcaacagtatgaaactgctgagaacagccttgccttcctgtgccaacaaggtttctcccttgagcatgccctctacgcaatgcaggctgctgggatcttcactctgggttgcgtattgctggatcaagagctgcaagtcgctaaggaggagagggaaacacctactactgatagtatgccgccactggttcgacaagctctggaactcaacgatcaccaaggtgcagagccagccttcctgttcggccttgaattgatcatatgcggattggagaagcagctgaagtgtgaaagtgggtct

SEQ ID NO: 1245 - DNA, 621 bp, Artificial sequence
  SuR L7-1F8-A11 comprising plant-preferred codons
atggccagactcgacaagagcaaggtgatcaacagcgcactggagctgctgaacgaggtcggaatcgaaggcctcacaacccgtaaactcgcccagaagctcggggtagagcagcctacattgtattggcacgtcaagaacaagcgagctctgctagacgctatggccattgagatgctcgataggcacgctacccactactgccctttggaaggggaaagctggcaagacttcttgaggaacaacgctaagtccatgagatgtgctttgctcagtcaccgtgatggagccaaggtctgtctaggtacaggcttcacggagcaacagtatgaaactgctgagaacagccttgccttcctgtgccaacaaggtttctcccttgagaacgccctctacgcaatgcaggctgttgggatctatactctgggttgcgtattgctggatcaagagctgcaagtcgctaaggaggagagggaaacacctactactgatagtatgccgccactggttcgacaagctctggaactcaaggatcaccaaggtgcagagccagccttcctgttcggccttgaattgatcatatgcggattggagaagcagctgaagtgtgaaagtgggtct

SEQ ID NO: 1246 - DNA, 621 bp, Artificial sequence
  SuR L7-1G6-B2 comprising plant preferred codons
atggccagactcgacaagagcaaggtgatcaacagcgcactggagctgctgaacgaggtcggaatcgaaggcctcacaacccgtaaactcgcccagaagctcggggtagagcagcctacattgtattggcacgtcaagaacaagcgagctctgctagacgctatggccattgagatgctcgataggcacgctacccactactgccctttggaaggggaaagctggcaagacttcttgaggaacaacgctaagtccatgagatgtgctttgctcagtcaccgtgatggagccaaggtctgtctaggtacaggcttcacggagcaacagtatgaaactgctgagaacagcatggccttcctgtgccaacaaggtttctcccttgagaacgccctctacgcaatgcaggctgttgggatctatactctgggttgcgtattgctggatcaagagctgcaagtcgctaaggaggagagggaaacacctactactgatagtatgccgccactggttcgacaagctctggaactcaaggatcaccaaggtgcagagccagccttcctgttcggccttgaattgatcatatgcggattggagaagcagctgaagtgtgaaagtgggtct

SEQ ID NO: 1247 - DNA, 621 bp, Artificial sequence
  SuR L7-3E3-D1 comprising plant-preferred codons
atggccagactcgacaagagcaaggtgatcaacagcgcactggagctgctgaacgaggtcggaatcgaaggcctcacaacccgtaaactcgcccagaagctcggggtagagcagcctacattgtattggcacgtcaagaacaagcgagctctgctagacgctatggccattgagatgctcgataggcacgctacccactactgccctttggaaggggaaagctggcaagacttcttgaggaacaacgctaagtccatgagatgtgctttgctcagtcaccgtgatggagccaaggtctgtctaggtacaggcttcacggagcaacagtatgaaactgctgagaacagccttgccttcctgtgccaacaaggtttctcccttgagcatgccatgtacgcaatgcaggctgctgggatctatactctgggttgcgtattgctggatcaagagctgcaagtcgctaaggaggagagggaaacacctactactgatagtatgccgccactggttcgacaagctctggaactcaaggatcaccaaggtgcagagccagccttcctgttcggccttgaattgatcatatgcggattggagaagcagctgaagtgtgaaagtgggtct

What is claimed:

1. An isolated polypeptide comprising a sulfonylurea-responsive repressor that specifically binds to a polynucleotide comprising an operator sequence, wherein the binding is regulated by a sulfonylurea compound, wherein said polypeptide comprises an amino acid sequence having at least 95% sequence identity to SEQ ID NO: 1240, wherein the sequence identity is determined over the full length of the polypeptide.

2. The isolated polypeptide of claim 1, wherein the polypeptide is SEQ ID NO: 1240.

* * * * *